US009296789B2

(12) United States Patent
Altermann et al.

(10) Patent No.: US 9,296,789 B2
(45) Date of Patent: Mar. 29, 2016

(54) VACCINES AND VACCINE COMPONENTS FOR INHIBITION OF MICROBIAL CELLS

(75) Inventors: Eric Heinz Altermann, Palmerston North (NZ); Graeme Trevor Attwood, Ashhurst (NZ); Dong Li, Palmerston North (NZ); William John Kelly, Ashhurst (NZ); Zhanhao Kong, Shanghai (CN); Sinead Christine Leahy, Palmerston North (NZ)

(73) Assignee: Pastoral Greenhouse Gas Research Ltd., Wellington (NZ)

( * ) Notice: Subject to any disclaimer, the term of this patent is extended or adjusted under 35 U.S.C. 154(b) by 633 days.

(21) Appl. No.: 12/678,976

(22) PCT Filed: Sep. 25, 2008

(86) PCT No.: PCT/NZ2008/000249
§ 371 (c)(1),
(2), (4) Date: Mar. 24, 2010

(87) PCT Pub. No.: WO2009/041832
PCT Pub. Date: Apr. 2, 2009

(65) Prior Publication Data
US 2010/0221185 A1  Sep. 2, 2010

Related U.S. Application Data

(60) Provisional application No. 60/989,840, filed on Nov. 22, 2007, provisional application No. 60/989,841, filed on Nov. 22, 2007, provisional application No. 60/975,104, filed on Sep. 25, 2007.

(51) Int. Cl.
| | | |
|---|---|---|
| A61K 38/16 | (2006.01) | |
| A61K 39/00 | (2006.01) | |
| C07K 14/005 | (2006.01) | |
| C12N 7/00 | (2006.01) | |
| C12N 9/64 | (2006.01) | |
| C12N 1/20 | (2006.01) | |
| A61K 35/13 | (2015.01) | |

(52) U.S. Cl.
CPC ............... *C07K 14/005* (2013.01); *C12N 1/20* (2013.01); *C12N 7/00* (2013.01); *C12N 9/641* (2013.01); *A61K 35/13* (2013.01); *C07K 2319/00* (2013.01); *C12N 2795/10021* (2013.01); *C12N 2795/10022* (2013.01)

(58) Field of Classification Search
None
See application file for complete search history.

(56) References Cited

U.S. PATENT DOCUMENTS

| 8,586,709 B2 * | 11/2013 | Attwood et al. ............... 530/350 |
| 8,592,556 B2 * | 11/2013 | Altermann et al. ........... 530/350 |
| 2003/0219467 A1 | 11/2003 | Miner et al. |
| 2006/0068386 A1 | 3/2006 | Slesarev et al. |
| 2010/0209999 A1 * | 8/2010 | Altermann et al. ........ 435/252.3 |
| 2010/0221185 A1 * | 9/2010 | Altermann et al. ............ 424/9.1 |
| 2013/0127612 A1 * | 5/2013 | Stadler et al. ................. 340/465 |
| 2013/0217612 A1 * | 8/2013 | Altermann et al. ............ 514/1.1 |

FOREIGN PATENT DOCUMENTS

| CN | 101864362 A * | 10/2010 |
| EP | 2203470 A2 * | 7/2010 |
| WO | 9511041 | 4/1995 |
| WO | 9700086 | 1/1997 |
| WO | WO 98/07830 A2 * | 2/1998 |
| WO | 03038109 | 5/2003 |
| WO | 2006102350 | 9/2006 |
| WO | WO 2009/041832 A2 * | 4/2009 |
| WO | JP 2010539928 A * | 10/2010 |
| WO | WO 2011/025394 A1 * | 3/2011 |

OTHER PUBLICATIONS

Samuel et al, PNAS, 2007, 104/25:10643-10648.*
Attwood et al, Animal Feed Science and Technology 166-167 (2011) 65-75.*
Leahy et al, PLoS One, Jan. 2010 | vol. 5 | Issue 1 | e8926 (www.plosone.org).*
Greenspan et al (Nature Biotechnology 7: 936-937, 1999).*
Wedlock et al, Animal, 2013, 7:s2, pp. 244-252.*
Buddle et al, The Veterinary Journal 188 (2011) 11-17.*
Williams, et al, Applied and Environmental Microbiology, Apr. 2009, p. 1860-1866 vol. 75, No. 7.*
Wright et al, Vaccine, 2004, 22:3976-3985.*
Attwood GT et al. "Analysis of the Methanobrevibacter Ruminantium Draft Genome: Understanding Methanogen Biology to Inhibit Their Action in the Rumen", Australian Journal of Experimental Agriculture, Jan. 2, 2008, 48(1-2):83-88.
Samuel BS et al. "Genomic and Metabolic Adaptations of Methanobrevibacter Smithii to the Human Gut", Proceedings of the National Academy of Sciences of the United States of America, Jun. 19, 2007, 104 (25): 10643-48.
UNIPROT Database. XP002624118; Accession No. A5UKB4, Jul. 10, 2007.
Smith DR et al. "Complete Genome Sequence of Methanobacterium Thermoautotrophicum Deltah: Functional Analysis and Comparative Genomics", Journal of Bacteriology, American Society for Microbiology, Washington, DC; US, Nov. 1, 1997, 179(22):7135-55.
UNIPROT Database. XP002624120; Accession No. 027038, Jan. 1, 1998.

(Continued)

Primary Examiner — Nita M Minnifield
(74) Attorney, Agent, or Firm — Loeb & Loeb LLP

(57) ABSTRACT

The invention encompasses components from microbial cells which are useful for antibody production, including peptides, polypeptides comprising these peptides, polynucleotides which encode these peptides or polypeptides, and antibodies directed to these peptides, polypeptides, or polynucleotides. The invention also encompasses to expression vectors and host cells for producing these peptides, polypeptides, polynucleotides, and antibodies. The invention further encompasses methods and compositions, especially vaccine compositions, for detecting, targeting, and inhibiting microbial cells, especially methanogen cells, using one or more of the disclosed peptides, polypeptides, polynucleotides, antibodies, expression vectors, and host cells.

13 Claims, 304 Drawing Sheets

(56) References Cited

OTHER PUBLICATIONS

Fricke WF et al. "The Genome Sequence of Methanosphaera Stadtmanae Reveals Why This Human Intestinal Archaeon is Restricted to Methanol and H-2 for Methane Formation and ATP Synthesis", Journal of Bacteriology, Jan. 2006, 188(2):642-58.
UNIPROT Database. XP002624121; Accession No. Q2NF85, Feb. 7, 2006.
Bult CJ et al. "Complete Genome Sequence of the Methanogenic Archaeon, Methanococcus Jannaschii", Science, American Association for the Advancement of Science, Washington, DC; US, Aug. 23, 1996, 273(5278):1058-73.
UNIPROT Database. XP002624122; Accession No. Q57672, Nov. 1, 1997.
Wright ADG et al. "Reducing Methane Emissions in Sheep by Immunization Against Rumen Methanogens", Vaccine, Elsevier Ltd; GB, Sep. 28, 1928, 22 (29-30):3976-85.
Leahy SC et al. "The Genome Sequence of the Rumen Methanogen Methanobrevibacter Ruminantium Reveals New Possibilities for Controlling Ruminant Methane Emissions", PLoS One, Jan. 2010, 5(1):E8926/1-17.
UNIPROT Database. XP002624123; Accession No. D3E1Y9, Mar. 23, 2010.
European Search Report corresponding to related EP Application No. 08833501.3; Mailed Mar. 11, 2011.
NCBI GENPEPT Accession No. ABQ87219; Jun. 21, 2007.
NCBI GENPEPT Accession No. ABQ87409; Jun. 21, 2007.
NCBI GENPEPT Accession No. ABQ86777; Jun. 21, 2007.
NCBI GENPEPT Accession No. ABQ87512; Jun. 21, 2007.
NCBI GENPEPT Accession No. ABQ87815; Jun. 21, 2007.
NCBI GENPEPT Accession No. ABQ86644; Jun. 21, 2007.
NCBI GENPEPT Accession No. ABQ86506; Jun. 21, 2007.
NCBI GenBank Accession No. X84218, Aug. 23, 1995.
NCBI GenBank Accession No. DQ419923, Jun. 28, 2006.
NCBI DBEST Accession No. CO004855, Jun. 9, 2004.
NCBI GenBank Accession No. DQ516856, Jun. 4, 2006.
International Preliminary Report on Patentability corresponding to related International Application No. PCT/NZ2008/000249; Mailed Jan. 20, 2010.

* cited by examiner

FIG. 1A

Comparison of Methanobacteriales genomes

| Methanogen | Mb | ORFs | %G+C | rRNAs | tRNAs |
|---|---|---|---|---|---|
| Methanobrevibacter ruminantium M1[a] | 2.9 | 2239 | 32.6 | 2 | 59 |
| Methanobrevibacter smithii PS[b] | 1.9 | 1795 | 31.0 | 2 | 34 |
| Methanothermobacter thermoautotrophicus ΔH[c] | 1.8 | 1873 | 49.5 | 2 | 39 |
| Methanosphaera stadtmanae DSM3091[d] | 1.8 | 1534 | 27.6 | 4 | 40 |

[a] genome size and number of ORFs are based on analysis of the single contig M. ruminantium draft genome sequence
[b] Samuel et al., 2007
[c] Smith et al., 1997
[d] Fricke et al., 2006

FIG. 1B

M. ruminantium draft genome statistics

| Genome size (bp) | 2937347 |
|---|---|
| Open reading frames | 2239 |
| Proteins with trans-membrane domains | 503 (22.5) |
| Terminator structures | 334 (14.9) |
| TIGRfams | 2304 |
| Pfams | 3315 |
| COGs | 1834 |

[a] Numbers in parentheses indicate the feature as a % of the total ORF number

FIG. 2

Vaccination protocol.

| *Week* | *Activity* | *Description* |
|---|---|---|
| Week 0 | Bleed | Pre-bleed (2-5 ml) and initial imm. in CFA 200 µg, ID 10-15 sites |
| Week 2 | Immunize | 200 µg Boost in IFA, 10-15 sites ID |
| Week 4 | Immunize | 200 µg Boost in CFA, 15 sites ID |
| Week 6 | Bleed | Test bleed 2-5 ml |
| Week 8 | Bleed/Immunize | Test bleed 2-5 ml, 200 µg Boost in IFA, ID 10-15 sites |
| Week 10 | Immunize | 200 µg Boost in IFA, 10-15 sites ID |
| Week 12 | Bleed/Immunize | Test bleed 2-5 ml, 200 µg Boost in IFA, ID 10-15 sites |
| Week 14 | Immunize | 200 µg Boost in IFA, 10-15 sites ID |
| Week 16 | Bleed/Immunize | Test bleed 2-5 ml, 200 µg Boost in IFA, ID 10-15 sites |
| Week 17 | Verify/Plasmapheresis | Project review, Plasmapheresis (if titer OK) |

FIG. 3

**Sheep antibody responses to vaccination with *M. ruminantium* cell wall preparation and peptides designed against *M. ruminantium mtr* and surface proteins.***

| | | | | Week | | |
|---|---|---|---|---|---|---|
| Sheep # | Antigen | 0 | 6 | 12 | 15 | 16 |
| T0040 | Cell wall prep | <50 | 3200 | 12800 | 12800 | 50 |
| T0041 | mtrD peptide | 100 | 51200 | 102400 | 102400 | 25600 |
| T0042 | mtrE peptide | <50 | 3200 | 1600 | 800 | 400 |
| T0043 | mtrC peptide | <50 | 1600 | 3200 | 3200 | 3200 |
| T0044 | ORF818 surface protein peptide 1 | <50 | 6400 | 6400 | 6400 | 3200 |
| T0045 | ORF818 surface protein peptide 2 | <50 | 1600 | 3200 | 6400 | 3200 |
| T0046 | ORF508 surface protein peptide | <50 | 1600 | 3200 | 3200 | 1600 |
| T0047 | ORF820 surface protein peptide | <50 | 6400 | 6400 | 6400 | 3200 |
| T0048 | ORF1850 surface protein peptide | <50 | 3200 | 6400 | 6400 | 6400 |
| T0049 | ORF819 surface protein peptide | <50 | 3200 | 3200 | 3200 | 1600 |

*Assay: Antibody titer was determined with an ELISA with Peptide-GGG (goat gamma globulin) bound in solid phase (0.1 µg/100 µl/well) on high binding 96 well plates. The serum was first diluted 50 fold and then further diluted in 2 fold serial dilutions. The ELISA Titer was calculated as the estimated dilution factor that resulted in an $OD_{405}$ of 0.2 and was derived from nonlinear regression analysis of the serial dilution curve. Detection was obtained using an HRP conjugated secondary antibody and ABTS substrate.

FIG. 4

Peptide sequences used for antibody production.

| ORF | ORF Annotation | Peptide Sequence | SEQ ID No. |
|---|---|---|---|
| Contig40_gene_697 | tetrahydromethanopterin S-methyltransferase subunit C MtrC (=ORF898) | IIAAF KLKGL EMLC | 1 |
| Contig40_gene_698 | tetrahydromethanopterin S-methyltransferase subunit D MtrD (=ORF897) | YNIGG TIEGF VDPKC | 2 |
| Contig40_gene_699 | tetrahydromethanopterin S-methyltransferase subunit E MtrE (=ORF896) | CTLPL DGLGH PFPLP | 3 |
| Contig40_gene_828 | cobaltochelatase CobN subunit (=ORF820) | YQSST YGSDG GYDDK C | 4 |
| Contig40_gene_829 | adhesin-like protein (=ORF819) | VQSGE VSGGV DIASS C | 5 |
| Contig40_gene_830 | adhesin-like protein (=ORF818) | VADIW NGSSN SVDAY C | 6 |
| Contig40_gene_830 | adhesin-like protein (=ORF818) | FTDNQ ATGSS NGGGA IC | 7 |
| Contig40_gene_1158 | adhesin-like protein with cysteine protease domain (=ORF1850) | SKSNF VINGN GHTID C | 8 |
| Contig49_gene_43 | adhesin-like protein (=ORF508) | CYKIS ENNGN KSYDI | 9 |

FIG. 5A-5

ORFs selected for antibody production: Nucleotide sequences.

| ORF | SEQ ID NO: | Nucleotide sequence |
|---|---|---|
| Contig40_gene_697 | 703 | ttggaccaagtcattgcatgtcttggtgcatgtttgtgcagttcttgtgcaattcttgggagttcttgctattcgtagtgtagcaagttacggttaggtact ggtgtacctcctattggttacatgtcttaggtataggtgtaatcggtgcattagcaggtgttaggtataattgcagcatttaaattaaaagga ttagaaatgctcggaccaatactgctagtatttgcaattgctcattggtttattagttgcaattgttgctaagaagattgttgaatgaa atccctgttatggaaagatgcacagctgaaatcgctggtgtcgtgtcgtccttagctgttctcgattctcctctgcaattgcagtggatctct attgatttattaaccgctgttgtagctcctgattcattgctctcttttacatattagttactatgctatccaacaccattcaacgca tgtttaggacctaacgaagatcaagttagaactcttaaatgtggtgcatccactgcattcttaaccatgattattactgtattctgcaatt tccgctggagatacgcatgtttgcaatttttagttgttgacttatcggctgtacgtctcattaaaatgttgttaatgcttcctacgaa gctgcagcatcttgttaaatgtccgattatgccgattatgcaaagttgaggaataa |
| Contig40_gene_698 | 704 | atggatctttaatatttattatgtgttgtaatcgcagtgtattattatggtgagggtgtacacttcattcctgtaggtgtgtcctgca gctatggctaccgctaccgctgtaggaactgtaccgcaatgtaagagctgtgtgcaggattaacgctgtcaggtattaccgcagcttcatgacc gtcaaccagtatgtaatcgttagttagtagcaggtgcagtttgttcaatgtaatgatgtgtatcaccatgcttattgtaacttattatatt ttcggtgttggtgtagtaccagctctgtaaagcagcatctgtttgacgtataagtggtatcatcatgttgaaccaagaaaataccaaaccagtaccgaa ggacagtatctcctaccgtcttacataaagtgttgacgctactgattcgaggattagttcactgagcagcattctctctgtagattagtctactggcaattaat gaatttgctactgcaaaacttaactgattgaggtactatgaaggttcgtttgacgctgtttatcgtgtttagcagctattctctgtgatgtcttatcaattca gtaactgcttcctataacatttgagggctactattgaaggtttcgtagacccttaaattcaaaagactccaactgaatcctgctgtgctgtt gtttctcttgtagctgctatttttcatgttttaatgatgataggtatttaa |
| Contig40_gene_699 | 705 | atggaccctattacattaggtgtgtagtcgcattgatggtgcagcagcaaccattgcaggtgctgcagaggactagaatctgacatcggttca caagtaacctaactctcagttcagttctcgctccacaaatggacacactacacgtatgataaataaggcagctctgggaaccagtagca tacgatgctggtgtattccggtgtattgcaactgcgtctgcatcagtggtatgtattataacctatagtgcaattgcaatgggttctact gtcgctgcacttgttcacgcaatttatacagtcacatcgcagctcattgatttaatagcgatagtttcggtatttgtaggaatcgttgtatttatgtatgggac gtattaaccaatccttaggccatcgcaggccatcaaaaattcgactactgcagctcattactgcatcgacctgcatcgtacgactgacggatcgatcgatcgcaagggatgttcat tatggtgcagaaagtgaataccaaaattctgtgctaggtaactctgtgagaagacaaaattgtaggatgtaggtattgtcatcgtatttattaatcgctgctaattactcttgaaaaag gctaaaaactcctatcgatgtaggtgagctttagagagacaaattgtaggttgacccttaaccgattctgtttgacttgtttgacttgtttcgtaagcttc tggattactgttgattcggagcttaagagagacaaattcggaccatatgaggaataa |
| Contig40_gene_828 | 706 | atgaataataataaagatatctctttatttttattgtgtctcataattcctcaagctattttagcaggggatgttgatgattatcg gatgctggtaattacactagagataattcacctttaacaataagttccacttatcaaagttctacttatcgatcgatgggatatgatgat aaaatgagaatatttatttcttagataaagttagtgatgggataaatctaaaacatgctgttctaaggcatatctcagataaagattcatctaacttgctctaactacatat tctatgaataatctttcttgttctaagagcaatttcagcttgttcgattatgttgtattttaagcattaaacttcagattttgatttaaacaatgatttaagctt aatagatttacttcttaatattataattaaattcaaatcagatttaaattcagatgtcttaaatcttgaggaagttattcagacagaaagttatcagaacttaacttat gaggcgatttgatccaaacttattaggatgaagtgagttcttaattgagatttcaattttaaaaatgatatattaatcttaaaagactataaatcc ccattaagtgatgaaaacacattattttatattttatataattagtgataaattacaggaaataactcttttttgatgccagtgcatgtgaaatcttagac |

FIG. 5A-6

```
aattccaattttctaatgtcaaattcaatataagaagcggaaccaaataatgcaatgagcgaggatgaaatctatgaactgatgctcct
tgcgatgcattcatcggccagtgggtaagctccaatgtggatgcaatgtaaccagtcttttaaacaatcatcctgaattgtcaaataagaa
ctgttccttatcttggaaccaccactctggaacatcaattcaagctccagttcattgaatttggttagaaactctacaattgactataagaag
atattcaatgaatttccaatgacgattgataaattattcaaggactcaaagagaaacaacttcgaaagcattcaagaatacacattgac
aatgaaggaagctcttttaatagacatcttaataattgttctcaaactttacaggatataaacgataaggcaaatcttaaaacgaattgctctat
atcctttatctattggacatgatgttcctatgagtctgcaaactgtacaggatgcaggcatctgaatattccgtgacaggtgtattca
tttgatgaatacgttctcaccttctcaatgagtccaaaatgtccataggatttgaaagtacaatgtatatccaatccaacaattg
gatttggtaaatgaaatcacagaacgcctgaatcaaaagatataatgtcattcctattttactgtccgcaggtaacgccgaacagctaaat
atcatggtgaaatattgacagtcggtcgtgagagaacttcaacaatcagcgattcttagagaatccacaagacttttgacatttatgtgatgaattatt
tccatgttgcatatgtgtcgtgaggcaatgcaatatggcctgtaggtctctaccaccaaaatcttgaagatgcaaatgtcctatattcagacggttcac
tctgaatacattaccaatgacagtgagcagtgagcaattaagcctgtaggtcttgtgactcttatattcaaataggacaggagcaatcatattgactttgttccagtt
catgagaatatagaactcttgactgataggttagacgcttggtgactcaagctcaagacttggtgactcaagctcaagacttactattgactattgactttgttccagtt
tacaactaccctcctgtaagacttgccaaacaatgttcagaacttgaagatgatgatgaataactgcctgcgggtataaacgctatctgaactagcataacgtaactggtcctgga
ggatactatcctgtaagactagctacaccgtcagtgtcgctcttcttcctgtagtagttggaatgttgattcttagagcattgtgatttcctagacgatattgttaaa
gaagtcgaaaagttagctaaccgtcctgttcctatattggcagatgcttcctgaaaatcagactgttaggcgtgcggttctaatcaacaagtgagtgagatattgatattgtgaacagctgaagcctgaag
gtccagattaccgaaggtcctgtctgttcctatattggcagatgcttcctgaaaatcagactgttaggcgtgcggttctaatcaacacgatgaagcttgtaaacagctgaag
aatgattggtacaatcaaatcaaggcattgcttcctgatgcgcatccctttactatgctggttaatgcaatgaggttgggagctgacattgtatttgaagatattatgatgatttgaagttaaaagtttgaat
ctctatgcaaacgcatcttccgatggcgatgaagctcctgaaatgcatccctttactatgctggttaatgcgatgaaccttaccactgtacagctgtagctcctactcac
gttctcgattaaacggatggggtgaagctcctgaaccctcaaagaggttggaggctgacattgtagctgatcaaatgccatgtcttgtcgaaagcacgcaaccacgatgttgccagc
caatatttggctgcttactattatatgatgattgattatcatgattatgtttcagtaataatcatatcaaggagttagagacaatctaacaagagcaatcaaggactgtgaattgcaaacaat
aaggaagttttattatcataagaagaggatttgcagtatgataatcagtacagagaattaacaataactgacatgttctccctaagctcaactttaaatgcttttcttaaagaaacact
gctatacaagctctattggaggagtagactacattggatatcactgaggactttccatcaggagaaatgcagagagacgagttggcgaacaccgttgcatcatagtctctcat
ttggcaactctattggaggagtagacttactaggactactcatgcaaggactccatcaaaggacatgtttctccctaagctcaactttaaatgcttttcttaaagaaacact
aaggataatcagactatcacttatcagtcgcagagaagttcactcactcactaggactcatgccctaagctcaactttaaatgcttttcttaaagaaacact
tactaccttacaattggatccactaggactcatgacactggaagcaatgaacaatactgacatgttctccctaagctcaactttaaatgcttttcttaaagaaacact
caaaataccctatatcattgatatccaaacagttcatgcaagaagaccaatctattcgatcagctatctcttgttattactgggaaaatattccaatctgactcattgaag
gactttgaatatggcgcaagaagaccaatctattcgatcagctatctcttgttattactgggaaaatattccaatctgactcattgaag
cgtgattatatccaacaggtcagtggatgtctgtaaggctctgtaacatcaacattgaccctttacctgccttgtgtcctggaaggttctgatgatcagctgtatctaataagagcctgatgatcagcaactgtatctgatacaattgtatagaagt
ccagagttcattgagtatgttccagtcaatataggcggattatgctcaaggatgcaaggatgcgcaaggagggcattcctctacaggtaagaaagttgaggactgcctaatgtcatagcattggaatgaatgagcctgtctgcat
ttaaatggagatatctgtgtgagagacttgacgaagaaagagaatagacgttatgttccgtgattattaccagcagttgttccgtgatctatacagttcacaggcacgtcttatg
tcatctgagcttcgactcaagtgcaggatgcaaggatgcgaaggagggcattcctctacaggtaagaaagttgaggactgcctaatgtcatagcattggaatgaatgagcctgtctgcat
atcatggtatctgtgtgagagacttgacgaagaaagagaatagacgttatgttccgtgattattaccagcagttgttccgtgatctatacagttcacaggcacgtcttatg
aactcatcaagtgcaggatttgacgaagagggctaaaaagaagagaatagacgttatgttccgtgattattaccagcagttgttccgtgatctatacagttcacaggcacgtcttatg
cgtcctgacggatggctaaaagaagaaagagaatagacgttatgttccgtgattattaccagcagttgttccgtgatctatacagttcacaggcacgtcttatg
gacaatgcatacaggatgctttagcttgttcatattacactatcgtaaacaatacgttaaacaataagacaattatgatagcgaatatggcctcaagtctat
gatgcacttagatccatgagaagcattagcttcaaggaatgtcaaacgaatcattagaagacattatgtcgctaagcattatgtcgctaagcattatgtcgctaagcattggcattggctagag
```

FIG. 5A-7

| | | |
|---|---|---|
| | | gattgcatctctattatctaagctagctatactctacagtctctggagaatatgcaataccgtatcttgcacctcctaacgggattat
gtgctgaatatcaaagcttgtgtcaatgtcatgacctgaacagatgagcttcagagttctatattgcagagtgcaataccaac
tattcaaatattactgggagatacaaacccctgtcgtattcatgaggcgctatccgatacagtgaataccatcccaacagactcctacaatg
caatacgagtattgataacgatgactcttgattactgttgcaacattgagaatgtttctataacgacttaatacaagtatctaaccct
aatgtattgatcaagggaatgatgcaggaaggctacagcggtcagaatatgtccaacagttcattccaacctatggatggcaggtaaccc
gaatggatcaaggaatgatgcaggaaggctacagcggtttggatgacgttacaatacgattataaggacaaatacgattaggagtaaaatcatgctcaa
agacccttcatctgtctctgaaacagtttggatgacgttacaatacgattataaggacaaatacgattaggagtaaaatcatgctcaa
tctgaaacaatgcatattcattgatatccatgacagagctacagttgcaaatgggtagcatgcgtgtgactgcagctgcgcgaaatgtgcaatgatgcaatgg
agtgatatagctaacacttggcacagtctgcttgctcaagttgatgctaagtgatgacgcaactcaaaatccgctcttctatacaatagcagt
gcattcaagtatgtgtcaaactctttgaatattgaccgcgaactacaaacagcagtgcagagtcagaaacactactgaaactgttcagactaactcaagc
gatatgcctacaaactcttgaatattgaccgcgaactacaaacagcagtgcagagtcagaaacactactgaaactgttcagactaactcaagc
tctaacagtcagcaaagcctaacgaaacactaatattcaagagacgaaggcagatctgtagaggcgctataagagcacaagcactccaatgtccaatcagat
atggccagtgattcagatgcaggaatgaacgatgcaaatgcaaatgcagatctgtagaggcgctataagagcacaagcactccagtgctcca
aaggacgtaagtatgcctatagctattggacgatgtgtttgtttattgtttagtggcattaagtcggttattcagaaacagaaagacgac
gatgattattaatgatgatgacgatgattatgaataatataatag |
| Contig40_gene_829 | 707 | atgtctctttggagctgtctcagcagctgacctaaatacagtccagtccgtgagttcagtggagtgacatagccagctcaaatctctgga
gtcgaaatggagaattgacttacgaagtccagaaattccagatagtgtttgaaaacattcagtagtcaggctcttgttgacagctatactcaggatcc
tctaatttggtatatgatccgaagcaaatacttgacaaaaaacggcaacagcgaacagatagcaagcaagtgaagactgttgttcaagtgtg
ggaagtgcagacgtgaggtatgtcattaacgaccacacaatgccaatgcttgcagatacacattgcaagattgatgactctataactcaagactacgagact
caggatgcaaaggaaatcacactgtaaatgccaatccattcactgttggtaatgcaggtctactggatctttgcatcttggtaaagacagatagaagcaagg
tttacatatgatgatgaaccgtgaattacgaaccatgtagcgacccctgtataaacttgccactttgcccttcaagccaggatggtctctatatcggaaccacctaaaatctctattggctgaagacagcagatagcaagcagtaccttccccttcaagccaggatggtctctataccttc
atgactgaagatgttgctcatccaagggcgaacagagtgtcatccgagggtatactcattagaaaatgtctctttttcaagaacagaaaatctgcaaatctcattagtgcttaagctggatatactaccaaataatctcactcatttagcccagtacaatcctccaatatggatatactagctgaacacatactataaatggctgggccataaccaatatgtaata
ggctcgtcatcctatctcttgatttatatgccgatgagcagagcatcctcctataagagcaagcgttattttaggcaaggctttgcttatcctgcagaa
aagaacactgagaggtttagatgaataatcacagttaagagctcattgaggcatgatcattgagagtctagttgatcattgtccatatatcttgataatgaaatgtt
aagataagttcatttaagaaatatcacactgctatgctctgcctgatgcgcttcttcttcactgatcttcactagctctaatagagctttaataatcttgataatgctaaaacgga
cctatgttcacaagcacattcaatggcggcagttaatccttaagcagcagtgtaaaataagcttgccttatcaaaggaagcaggtattgctggagttat
tacggatgcttgttttatgatgttggagagcttcattaagcagagtgtaaatagcttgccttatcaaaggaagcaggtattgctggagttat
ccaagcacccaatcgattcatttttacaatctaacagattcagacttctaacaagcgccattcattatccatggcagcaatatcctatcaatga
tacaattcacttgaaagaggtttcaagcgatatatattcagcgataatatattatcatggcaaagctcatttattcacacgcctttgattggtaagtctaagcttcatgtattcctcttt
gccgattgccaagctgaaagatccacactaatgctacatcaatgaggtgtctcgaatattcaaacgctatttgcagtaccaacaatgctcttgtcttaat
gtggttgatttaggaaaatccctcagttaaggcaagtcttgtctctatttgatgtgatgcaagtcaaaaacagcactgcaaaagcaaacagcactgcacaattcctaaatct
ataacaaataacggtaaattgatctctatctgttgacttcatctatactgttgacttctatctgttgatgtgatgcaagtcaaaaacagcactgcaaaagcaaacagcactgcacaattcctaaatct |

FIG. 5A-8

| Contig40_gene_830 | 708 | ggtgctaataaggattatatcttattgatgatacaataaggcctattgatgtcaagcacagtaatgggcagacaatcctaaggtcaattat
acagttgtcatcattgacaagaaaaatcaatgtattagatgagattaccatatcctagccctcttatataatggaaatctagaaagac
ttggcttatccgcagagaatatcacttgttcttgactattgaaatataactgtaagcggtggcgtgattgtcgatacattagatgattccacatatatt
aactctcaagcaacaacagaacagatatattggaatgtaaatgtggctgatgcgatgtatttacagatgcctttgttatgttccttacaat
tgggataagaccaacggatacatgccagtttggaatgcaagattcaatggttgcagttgcacttctcacctcttgtctcctataggaccaatcaaat
ataggattcttcggcaagaacgatatggatttggattggtgtctatgatgtgagcaagcttatcaaatcagggaaaacactttcactttagaaaa
gaagctggaatcactgctgtatatccaagcaccttatggcattctataatgcaactagttccaatagcttaaagaccatttatatctataat
ggtgcagacctattggcaaatgagaataacttcctaaacaggactgttgcatctgacagtcacttagatatctcctctttaaggagtaatt
agcgctaagcttatgttttttagtgccggtgctcaaaaggtgaagactctccaagtgtgtccaagtgtgtcctttgtctctacagctcaaccatt
actgtaaacagttgtagatgtttcatcattgttcttgactattatgttcttaggcaagtctggacaaatgtgtcctctgaatattctggtgctgtatttgcagt
atggcacttcagcagctcattgttcttgactattatgttaggcaagtctgtttaggcaaatgtgtcctctgaatattctggtgctgtatttgcagt
accgataatgtattaaaagttgacttgaccaatgacgcttcaggaggatctgtttttagttgcttgactctatattgatgcaagactgtaaac
agcacagaaattccctcttgatgcaggtaaaagcactgaaatcttttagttgatgataaaataaggcctgttgatgcaagcctcaatcctattggt
gcaaataatgccaagtcaattatacaattaactgtaactgataaggccagcagaatatcagcttcttcttgatgccataactgtaaatgggggctaatcattgat
tataatggaatctagaaaggacttggcttatccgcagaaaaaccaccgcagaactgatctgaaggttgaaattcctaaagatgaaagatagtt
acattagaatacttgaccacctatctggagcaaaaacaccgcagaactgatctgaaaaagtttgtttatgatgttcttatgatgttcttatcaaatcagct
gggttgttatgtatcatcaactgggataagacaaatgggtacttatgccaatatggtactgtcagttaccagaccactcttttagcattctataacgataaaataat
gccactagagaccagtccaatatgggataagacaaatgggtacttatgccaatatggtactgtcagttaccagaccactcttttagcattctataacgataaaataat
gaaaacaagttacctgtatagaaaagagaaatgaactactgtcagatcagtttccaatgcaaataactcttttacccaagcaacatgttacaacgttacctgtaataacaaat
agaactaccgtttatatgtacaatgtgcagactattgtcagactcaagttcaagctcaaatagtgtcagtgcaaataatagttacctgtaatatagttcttacccaagcaacatgttacatagttcttagat
ttgcctgaatccaaatgatgagattaaaagctcaaggcttataaaagctcaaggcttatgtttttgctgcaagcgccaatcctgagaagaaagctcattgtcaac
aacaagacatttaacaatgctctacaatgtcagtgcaaatagtgcagtgcaaatagtcgtgtgatgcaataagtgtgatgctatatattgattaggcaagcatcctaataat
gtgtcattatagctcagctagctaggcaggctcaaccattctgctcttcaattgggaagcaacgtctcttgatgccactcctattcaaggatgtctcaaatgtaatcatcaataaggaccttaca
atgatcaattcagctgaacaatatatgcaagaggagagagagaaggcaggcatgctgtcacggggctgtaaacgctccaccacaaccgttcttgacctcaagtgtgtgcttcaatc
ataacaggcgaacaatatatgcaagaggagagagagaaggcaggcatgctgtcacggggctgtaaacgctccaccacaaccgttcttgacctcaagtgtgtgcttcaatc
ggagtcaagttcgttttagataatgcaaaacacaattcttcaagcaaggctgtaaacgctaataaccgttcttgacctcaagtaaccagcttcatgtgtgcttcaatt
aacatcaaaaagataataatctctttgttgatgatgtggcaatataatctaattgcagtatctgtccattcatgtttgaagtaaccagcttgcatcaataccaaat
gcccaactagaaacttgaccatagcggcaatatccagataaaaagcttctgtaatacattatgaagacatgttacactttgaagataaggttccagataggatttaat
tctgtagttgttccagaggtgggcaaatacttgaagtgaaccttacagatgccacaggagtcaagctttgttgctacccctaaggatcaagctccagataaacctgaaggatacaaggaacataacacctttgcaattgca
attgaaggaagtgtatatgatgattattataatggctaagacaacaatgccacaaatggccacaaatggccagcttttgtgaccactttgttctgccaccttttctgcactttgaagattaagttaaccatcaaaagacaaaagacaaagatttccacttcttctaagaca
ttcctttggtgatgattattataatggctaagacaacaatgccacaaatggccagcttttgtgaccactttgttctgccaccttttctgcactttgaagattaagttaaccatcaaaagacaaaagacaaagatttccacttcttctaagaca
tataaggcaagtgctaagacaaagccatttctgccactattcaaaaggcactgcaactgtgcaactgcaacctgaatgtaagcgtaagtgatgtaagcttaacactcaaaagacaagctatttcctttcactgtt
aatgaaaaacctatagcgctacaactaattcaaaaggcactgcaactgcaactgcaacctgaatgtaagcgtaagtgatgtaagcttaacactcaaaagacaagctatttcctttcactgtt
aagtatgctggcgatgatgtatgctgggcccactcaagcagtaagtggtggttataaatag
atgaagaatagaaatttttgataagtttagcttaattctttattgttctaatgctgcctaggatctgcttatgccgcagattaagtccagtg
actaatggaactgtttctgaggtgtgagttggatggcaactgccaatccatacgcttctcaaacaggaggccaagaatacaatctgagaatta
agctatgatgtcccgaggatgtttagtgatgtccagtatgcaggactctttgtaatgttagggtctgcacagggagctatggtgcc |

FIG. 5A-9

```
cagtccaatgtctcaataacatccaatggtgagacaagtcaagcgaagtttaaattatactgatgcagtggcgacggcactgtc
tatatagtaaatgaccacatccaccaagtctattccgactatcagatgatttataatatcactgataggttcaagtgcaaccggtcaaata
aagatcaatgtaacaacaccaaactgaaggatgctaattttgatgcagaatcaaattaatcggtttgtctttgcttatatgacgga
agcaataatagatttgattattggttggattccgtcaggcttgtcaaatagtgcgattcagttcagttaccaaagctaattttactgtgggaact
gtaagtcctttcttaagtgcaacataagaaatattgcacttcagaccataagtggatgtaactccattcattcaataagcaagagttaactttaattcaacc
gaactcatctctgattccatgttccatgttctctttgacagttacaaagaacttagaagaaatattgtaagtcctgacgtactgaactgtactact
aaatcttttaagaatgttctgttctgttgatagcagctcctgcttctgctaataatctggctaataatgtataatccatgttgatgaaacaattctgttgcaaacattaga
gcagatgatcctaccactatggatagcaactactcatccattgttgcacatgttgactcttttacacatggtaaggaactgaggggagttattcgatagcgatggatgc
cgttatgacattaggcgcaaactactcatccattgttgacgcttgactttacacatggtaaggaactgaggggagttattcgatagcgatggatgc
gtatatggccaattgtatttcaaagacattaaatacccgagctgagagctgttacatatccgttctataatgttatgattgaa
ggccttgtgacaaattgtattttcaaagacattaaatacccgagctgagagctgttacatatccgttctataatgttatgattgaa
aattgtaaattcataaacacccaccttccacagtactgaggaggcgcaatctacattgctgagacaatgccaccgttaaggaatgcagcttt
gaaaatgctactgaaaggatggtggtcgatggtaggaaaactgtttgcagttgcgggttgttgtgttgcgcatatttcactggttgttgca
actaccggcgagccattagttggtaggaaaaacttggattaatcaatactgtacattcataagaaataaggctcagttatgaggcgctgttaat
ggaggagctatctattggcaggaaaaacttggattaatcaatactgtacattcataagaaataaggctcagttatgaggcgctgttaat
tggcctgcaggtaaatcaacggtacaatagctcgacaaccatgaaagcagatgaggcgcaaacggaggtgctatggcctcctggtatctgagaccaatgc
gcaggaagctaaatcaacggtacaatagctcgacaaccatgaaagcagatgaggcgcaaacggaggtgctatggcctcctggtatctgagaccaatgc
tactttcttgattgtaacttttgtagataactctgcagaacatctcaaaacatgaaactattccattgactgactgtttacccttgtagatacaacaacaggatcaatcgttgtggagagaacctgtttctgctataga
gcaatcatgataactggaaactattccaaggctgaaactgtaaatacctatgcgatcttatgtgaactgttgcaggaactgaattccattgactgactgtttacccttgtagatacaacaacaggatcaatcgttgtggagagaacctgtttctgctataga
ttaagcgtagagatcaatggaacaacatcctgaacatctcacacaaggctgaatctgaaatcctgcaggctattatggtgcatgttgtgcaagctgaagatatggaccgatctttagatga
tattatgtaactggaaactattccaaggctgagctttagcaacactactgaatgctatttgattttgatcaaatatctaacaggatcaatcgttcagtttcattgcataacaccgatctttagatga
attgcttttagaggcgaatatgtaaatcactaaggatgcggagctggcttagctcctatattggatgcgagcttgcaggacttgaaaatgctgctacacaaggctaatgctaaatgctggctacacaagcgatattaacttattt
aactatcttgttgaatttttatgtgatggcgagctggcttagctcctatattggatgcgagcttgcaggacttgaaaatgctgctacacaaggctaatgctaaatgctggctacacaagcgatattaacttattt
gatgagaaaataaggagtaaatgctaaacgaatcaactatttccatagctcctatatggatccatacaacaaggctatttgtaagaatatcagatgaattcatagc
caagaagttataggggaatccagctattctccaatagctcctatatggatccatacaacaaggctatttgtaagaatatcagatgaattcatagc
tcattcagaaatgtcaccttcaatggagctatttcattacaccactgaagctactctgaaatgactacactctgaaatagacaacctgattgactgactatttgg
actcttcctgctcttgcgaagggcaagcttgcatcaatggagctatttcattacaccactgaagctactctgaaatgactacactctgaaatagacaacctgattgactgactatttgg
tggcctccagcttaatgatgagtcctcttgattaaggaaggacaaacattacttcattaactgctaagaagctatatatccacgtaccctt
cttgtgtctatgactttctatgcgaatatgtaactcaaggcagactgtaaatccatgtacaagtacattcattaaatggtcgatttattatttacgtagctaatgtt
gtgcattctataattgactgaatcaagacactgtattgaacattagtacagaggcatgtcctgcatcctggatctaattgtatgtttttcgctcaagcgct
ttgaaagacttgttatgacagattctgttattgaacattagtacagaggcatgttgaacggtactaccagctctgtagaagagaaagttcttgat
caagcaggtgaagtaactgttcttgtcaatggcatccaatgaaatctccttgtatcaccgatctaccgatctaccagcttagcacttcaacatcgttcttgttgaatat
ttggagacaatcctctgcttgcgacgttacaatagcttctgaatatatgctgacgtgaaggcttgttatgctgactactgaaatcattgaaagtcaatgtaacaaat
gaagcttactctgctgactttcgtgacgttacaatagcttctgaatatatgctgacgtgaaggcttgttatgctgactactgaaatcattgaaagtcaatgtaacaaat
gacggtttggaaaagccaattatttgattgaattatatgctgactgtaaggtcgactatgaacatgttgaaatcgattgtggcgaagc
gtgcattctataattgactgaatcaagacactgtattgaacattagtacagaggcatgttgaacggtactaccagctctgtagaagagaaagttcttgat
aatgtcctaacttaatcgacgacaccatcaggcagccagtgactgaagaccactgtaaatggccagacaatcaggcaatacacagtctat
```

FIG. 5A-10

```
gtaagtgctgctggaagtctttagctctgaaagacaatcactcctaccatatgtataacggttacttaggcaagactacgcttatcctaat
gagacaatcagctatttcgacaccattcagttgagttatcattgaaacttaaatgtaccacttaatgataccacttaatggcgctacagttctt
aacagaactgatgtatggagcttgatgtcccagatgatgttgaatttgcagatgcatttatctatattgataacaactggataagaccggt
gcaaacatccctgtcttgaacttaacattcaatggagaaactgttgctcctatggaagctataggatcaatccaacttagcagctccggc
aaatacggataacggattaatcgtttatgtctggcttgtctggcttgtgaagctgttgaagaaaatacattattaatagaaaaagagtttaacaagact
gcagtttaccccagactacttctagcattctataacggagaggacgttgaaagttaacagcgtttagaagttgaattgttgatgaccttgctatcatggttgctgacttgtta
tataacagtacaacctattaggaaggaggacgttgaaagttaacagcgtttagaagttgaatgtgttgatgaccttgctatcatggttgctgacttgtta
gtatttgctcaagcgctcaagcaggtgaagtaacttgattgtaaatatgaaacatatgagaatgtctgtcggaaagaactatcctagcacttcaacaa
aatgtattgtgtcgaatacattggacagtctcaagcaatccaatgaagtctccttgtttcaactgaggaatcgcatatgccgaaccgacaatgtatta
ttcattgtcttcgaataacgtcacttctgctaaagcacactgttctatcatattgactattgctgatgcgactgtgtagacagcatagaagctgaa
aaacttgattaaccaatacgtacagtagacactattgatgtgataacgcagtgactgaaaaacatactactcctgttctgtctctatatataacgttacta
atcgattgcgtgaactacgcttatctctaatgacacaattcaattcttcgacgctatccagtgacgctgtatgatgctatcacagtaaacggtggtaataacttgacacttaaatgataacc
gtaactacagttgtaactcaaacaaccaatgcacctgccctgttctcaatacaaacaacgttgatgatcagaattcgttgaggccttttctatcatttcactcctatcatttcactcctatgctcattacagagac
acctatcttggaactcggataagaaccaatggcacctgccctgtcctctcaatacaacaacaatgtgaaactgtcactcctatagctcattacagagac
gcataaacttggaactcggataagaaccaatggcacctgccctgtcctcaatacaacaatgtgaaactgtcactcctatagctcattacagagac
caatcaaaccttggaaccagctctcaaaatacggctatgattgctgctcgagtacatcgctgcacctctatattgacaactgct
gagcttctaaagattatgatgcatctgctcgtctatccaagcactcttgtagcattctatgattgtgaagctaactgcacctctatattgacaactgct
tacatgttcaatggcgctgacttattatacaatgcatatatcttcttaggaagaccgttgaaagtaacagcgtttatatattgattgaataatggt
gacgatatcgatgaagcaacaactgtagtattgctgccagcgtcaagctgaggaggtaacttgattgtaaacgtgatgaatacaccaat
gtttggaaggaacagcaatgtccttcaacaattgtcaacaattgtaacaaacgttgctgaggaagatgctgtcttcaatgtaaccctttatgctgacggc
gcatttgcaggcacaacaatgtcttaaagtcaatgaagtaggcgcttatacactgtcagtgcgcttatgcgacgacctgttgacgacctgttgaggatgctgaagctacagtaaacgtggc
gttgaaataggcagtcagttcaatggcttaaagtcaatgaagtaggcgcttatacactgtcagtgcgcttatgcgacgacctgttgacgacctgttgaggatgctgaagctacagtaaacgtggc
acagtcaaagggcagacaatgaaatgtaacttaggcaaggactcacctgcatctggatcatctggaagatcagaactgacatatgaacatgaaactgacattgcacactcatcaatgtgtatct
ccggatatcctctataacgtaacttaggcaaggactccttgcatctggatagactgccaacagaacctgcaggaatcctgcacttaacatcacattgaaacctgaagacgct
atttcattgaaatccaaaatgtattgatttgtatatgtacagagaccttgcttacaactggcttacaactggatgcaaatatgcaaatgctgccatcatgaacaactgacactttagtgtatatgatgtaagagcacctt
gattcgtagctgatttgcacattacagagaccttcaccttacatgttcaacggcgcagatcttattgtccaatgactggcaaatatgactacctatccaagtgttttggttgcaggctacgaccaagaa
gtcgctcctgttgcacattacagagaccttcaccttacatgttcaacggcgcagatcttattgtccaatgactggcaaatatgactacctatccaagtgttttggttgcaggctacgaccaagaa
ttagaagcaggggatataatgtattcacctttacaagtttcctgatgatgtttggacgcactactactctttgtgaactttgtgaatacgagcttgtttctgttgacgctaa
gtatctgacagcaggtatgaaaccattgcctgatgattggaacgcactactacttcatctttgtgaatacgagcttgtttctgttgacgctaa
agtgtttagacattgaattgctgatgtaattgatgtgcacttgatgtgcacttgaatcttccaactcagttcaacttctgctgtattctaacttgcgtattgtccaagctcgtcaatcaata
gtaaacgagaaagctttgttgcaacgggaagcactactacttcagcaatttgtgaacaatgtcttagaatttaacattccaagcgttaattcagcgacaattcagcgcaactgcgaaacttgcttaagcta
aacacagtatcattgttgcaacgggaagcactactactcagcaatttgtgaacaatgtcttagaatttaacattccaagcgttaattcagcgacaattcagcgcaactgcgaaacttgcttaagcta
ttaggctgaatacaatacgtctatcgatgaaacaactgctgcagaccactttagaacttgaacttgaatctttagaatttaacattccaagcgttaattcagcgacaattcagcgcaactgcgaaactccacttgtgaccca
accatgagttctatatcgatgaaacaactgctgcagaccactttagaacttgaacttgaatctttagaatttaacattccaagcgttaattcagcgacaattcagcgcaactgcgaaactccacttgtgaccca
accatcagacccagttgatgaaccactgtaaacggcgcagacactttagaacttgaacttgaatctttagaattttaacattccaagcgttaattcagcgacaattcagcgcaactgcgaaactcctagatgagat
gtcttagatataatcactatcactcctcctctgtactctacaacgtaacttaggcaaagacttggcatatcctgctgagaaatcacttctttc
```

FIG. 5A-11

| | | |
|---|---|---|
| | | gatgtaattacagtaaatggagatatcattgtcataggaatgaatgattccacttatcttggctctaagacaacaggacgtactgacgtatgg<br>gacttaaccactaatgaagatattatcttgcagccggataccttatgttgcataacctggatacaaccctgctgaatgcctgtatgg<br>aacaccacattcaatggcgtaactgcctcctgttgcactcctgttgcacatagagaccaatccaattggaacctacgcaaatatggctacgactt<br>atcgtttacgatgtatctgaccttattgtagctgtgtgaaaacacattcaccttagaaacagaaaatgaaccactgcagtatccaagtacc<br>cttgtagcattctataatgcctgaatcagcacattgatatccgataccatacatacaatgcgcagacttattcaatgcaaacaacttc<br>ttaggaagacttgttgcatctaacacacattgatatcgattcatttgacatatcagtagtcgcgctgacctttagtattgcagctagcgct<br>caagctggagaaggtagcctttgtcataaatgcgatctttgtagctgacatctgaatgcagcaacagcgtagatgcatatgctattgac<br>ttaggcaaaaaccctaaggcatctaatgagtatcattgttgcaaccgattcaccattctagcattgcaacagttcattgttgttgaatac<br>aatgttccttcagctgagcaagcctcgttagcgaattctcaattgttgctgcaaccaacaatgcactcgctgcactcaactctgccgaagc<br>aacggcgcttaacacttctacattcgcacttctatattgacggcaagcactgtaaacgactgaaagctaaggtaaactacacagtctta<br>tttgccaatacttatcgatgatacaatcaggcgacttatttgatgaagtgaccctcactcctctgtattatataacagtaactagcacat<br>gtcagcgataaggatacgacttatttgacacaatcactgtaaacgtgatgtgatgctgattcgaagtgcatacctttatgttgcatacaactgggataag<br>cctccagagacaaatcgtcctatttgacacaatcactgtaaacgtgatgtgatgctgattcgaagtgcatacctttatgttgcatacaactgggataag<br>acaaccgacgtactgatgaatgaacgactcaacgtcctcagatgcttcctcagatgctaaaatgcgctacctttatgttgcatacaactgggaacc<br>actgcaagtgaatgcctgatacgagactacttcttgtagcattatgatgctctaaatgtcactcctgttgctcattacagagaccaatccaatagtggaacc<br>tatgcaaatatgctatcaagactttacattttgtagcattatatatgttgcaagcaataactgttagaatttatatcactgtatttgatgaatcctatcc<br>actacaggcgtatatccaaaacaactcttaaacagaactgttgcaagcaataactgttagaatttatatcactgtatttgatgaatcctatcc<br>ttattatccaactctatgtatttgctgcaagcgctcaagctgcaagaagaaaccttattgtaaacaatgaaacattcactcactgtctgaatgaact<br>agccaactctatgtatttgctgcaagcgctcaagctgcaagaagaaaccttattgtaaacaatgaaacattcactcactgtctgaatgaact<br>tctaatagcgtagatgcttatatgttgcttgattgaaaatgacccctagctcaattctcaatgatgtatcattgtagctaccggttctacaatcctt<br>gcattagacaattgtcgtgtaaatccaaatatcaaacagctctgacttgcaaaactctgatgctgctgaactgatccacccttg<br>gatttagtgacaacgtattccaagatgttgctctaacgtgtgctaatgtagtaatgtagtaaacataactggcgtgctattgtggaagatgcaaatgta<br>attgttcagcaactgctgacaatgaagcagccacccctcaatcgacactccaaacatcagaatcagtgacaacttcattgacatgatgac<br>ggaagcgttgtacctgaatcagtcaaaccattcgagttgtaactgctaaacaactgctgtgtaactgctgttgatgtaactgcgtatccaacaactgctgtaactcaagctactgacaac<br>gcaattgcagctgcaaacaggcttctgtaatcaatcaagtaactgctgtgatgtaactgctaactgctgtgatgtaactgcgtatccaagatggtaacattcct<br>gctaaacaggcttctgtaatcaatcaaaccattcgagtttgatgtaactgctgtgatgtaactgcgtatctcaagatgcagaaacaactgctgtgatgtaactgcgtatctcaagatgttcaacgttggcaaatacttcgaagtc<br>aacttgacagacacaatgaaactccaaatgaactcaactcttaggacacaaaaccaagcttactactgtccaaataaatggctactacaacggtagcttt<br>gcgaaaatagtcttcaactctcaagtaactgctctcaggatagcttactactgtccaaaaacctctactactgtcaaagagaagcaacatactaagcaagcgctaagacaaaacattaact<br>gcaacactcaagcgtgtacaacaaacaccaatcaagcgtaagaaaacctcttcacagtaagaaaacgcaaatcctactcgcaactacaaac<br>gctaaggtgtagcaactgttaaagtaagcctttcaaccaagaaaactacagtttcaccagcaattcgctggagacgatatgtacaccaaa<br>tcaagtgttacaggtaagtaactatataaataga |
| Contig40_<br>gene_115<br>8 | 709 | atgaaggtcttaaagatagcaattatcatgcttattttaatcatatctctgggagcggttcagcaacagagaattttaataatgatttaagt<br>gataatggactaaacgataacacattaagcgacaacagcttaaatacccttaagcgacaacacttaagtgataaagcttaagcgaa<br>agcacaatcatccaaaatgatcatgataattaaagatacaaataatgataataaaagatcctaaaagatcctgcgagacatttaca<br>gacttacaaatggaaataataaatgcaagtgacctttagaattgacagacgactataataacaatgaaactgacatatcacattaaca<br>atctctaaaagcaatttcgtaattaacggaatggccataacaatagaacggagacaatcaatgtgccatattccaaatcaacgaactaacata |

FIG. 5A-12

| | |
|---|---|
| | acctaaaaaatctcaatataataatgcaaactctacaaaggacagcgccctattactcaaccaggctctgagcttgagacaaacaatgta<br>accttcatcaacgacagctcagacaaagagtaatatttgcattggagcaaaatatacaagcaataatgataagtttatagactgcacatcc<br>ctcaatgatgagtaatcatcctggtgaataactatcaacaacgatatttgaaagctccagccattgaagctccagccattgactgggcttcgtc<br>aacagtttggaaattcctcaatctacgtttaaacacaacattgcaaataccacctccaaatacgctacagcaatgcaaggagatcgagaa<br>acagtaattcatgattctaaattcattaatctctatgcaaacctactgcaggagcaataggattaaaaagaattgaagaggctgaaattgac<br>aattgcacattcattaatgtgagttcacaaaaaaatggagggcaatattccttgacatatattcagatagcgaagacgtaccaataatgatt<br>tcaagatcctcctttgttaattgctacagcgaattcggaggagcaatcctatctctttaggggaaaatcacattggaggaagacaattcaca<br>aacaatgggcattccttgacggaggagcaatctattctctgacattagcgcattgattatattgcagcttcagcttcagcaacaatactgtagaa<br>ttagatgatagaggttccttggagggcaatattccttcaaactccacttcaaagacaataccaacaaagagtgagtttgat<br>caaactggaggagccctatatacatgattcaggctactcacttgaaaacatagctatagcggagaattcaatatgcctgaacaacgaaagtat<br>gatatcttcacagactcgatgggaaatcgccacactttaccctcatagaaaatgaaatcaatgtgacaacccctcgaaatttgacctacgtgaa<br>gaatcagtatcgccgttctgagtcgaacttaccctcatggttcatgttggcattgaactgtagagcttagaacctagagcagaagaaggcagaagaatttca<br>tgggatgggtgactccagttaaaatgacatctctgaaaacaacatgcaagacagcttattgcaatattcctttcagaatatgacgttcagaagcttgagcttgaaagattca<br>ttttagcctgaaatggacatctctgaaaacaacatgcaagacagcttattgcaatattcctttcagaatatgacgttcagaagcttgagcttgaaagattca<br>ggagagtataacctaggcccttcctatgcattaagttgtttggagtattccttgtgctctcttgattccttcagaaaaactcactgaaacaagctta<br>gcaataatcgcaacagatgacagcatccattgcaggacgcagtcttgtccgaaaacgatgactattccaagacaattctctatatgcgcaagttgaccctcagtgcct<br>tcccttcaaaatatggcgttctccttgttagtggagaatagagacaagcatcttaccatcttaccataaaactatcaataggatggaagcaatttgaattcactgatgtggaaat<br>aaaaatgatagtaaccaacagctggggagaatagcagtctactatgcgaaaacgatgactattccaaagacaattctctatatgcgcaagttgaccctcagtgcct<br>tgataatcaaaaacagctggggagaatagcagtctactatgcgaaaacgatgactattccaaagacaattctctatatgcgcaagttgaccctcagtgcct<br>tctgtcgattccaataatgaatcagtcattacaataaaactatcaataggatgggaagacacattgattgctgctgcgattcactgatgtggaaat<br>gaatacgtcaatgaatttgaggcttgaagatgatctcattgcaagatgaacctcaccattttggatccatacaatccagttcatcataacaagtcagct<br>atctatgtcaatgatgatgaaatacagcaagatcacatcagactgcatcccaatttagaagtggaagacagcattatactacagatgaagacaaagaaaagaa<br>aaggaagggatgaattgacgttaagatacagatagcctttaccagtgacggtagacctcgcagtcctgtgactggcatctgaagcgcagtggcatctgaagcgcagaggtctgaggaaggttcaagtaaggatgcatctgaagcgcagaggtctatgagagatgaggaataccttgagcatt<br>gcaaatctaaatggaaatgggtagacctcgcagtgacggtagacctcgcagtgacggtagacctcgcagtgacggtagtgcatctgaagcgcagaggtctatgagagatgaggaataccttgagcatt<br>tcttctagaatcaataacaagaatagactgcttagcccaataaaccataaaccataaagatagttcaatggattcttaggagatgaggaataccttgagcatt<br>actttaaagacaaagctacagataaacctgcttagcccaataaaccataaaccataaagatagttcaatggattcttaggagatgaggaataccttgagcatt<br>gcagtgcaaagctcaagaagctacagataaacctgcttagccaataaaccataaaccataaagatagttcaatggattcttaggagatgaggaataccttgagcatt<br>gaagttgctaagattactgtaaagtacagaccccttaagcctgactgcccaataagttcacagttcacagttcacaaacatactcagctaaaccattcc<br>gcaagcttcaagacagcaaacggaaaggccgtaagcgtaaaagaagttcacagttcacagttcacaaacatactcagctaaaccattcc<br>aaaggaactgctactgtaaatgtaagcctaaacaagaaggaacttatagcttactgtcagttgcagttgcgagtcaattgctacttct<br>agtgcaaaggctaaattgacattaaaatag |
| Contig49_<br>gene_43 | 710 | atgagattaagatatttgcaataattagttcaattcttttaatatttttagttccagtagttttgcaagtgaaactaatctgattcaata<br>gaattaaatgattttagctgatctgattcttctactgaaatagatgattctactaagttctaatcaagatttaagtcttaat<br>cagaattctgattctaattaagcaatgaacaagaattatattctaataaactagtgaaactctagattcaaattcacaaagttcaaat<br>gatttatcaaactcctatattgtcttcaaatgagtaaggctagctgattgaattcaagcttgccagttcaatacaagccttaacgat<br>tcaaatacgatctatgtaaactcatcctatattggtctgatgagtttgaactcaatctaatacaacaataaactgtttaaatccataataataa<br>gctgcaactactgatttaaataatgtctatattgcaaatgggtttataatataactcttatcagttaaggaagctctgtagaggtctcaatattcaccttt<br>ggagaaagtcttaatgttatattaatgcttccaacgaaacaatatcttatcagttaaggaagctctgtagaggtctcaatattcaccttt |

FIG. 5A-13

```
acattcaggaatggctatgcaaataaggagggcaatatatgtggataaatcttcctaaacattattggagccttttgattcaaacatt
gcatatgtcacaagcgataacggatatgtgggctatctacaataatgcaggcttttaaagctctataacaccacattcaaaacaataag
gtggtagcagcatacaacatagtctctgaaggtttgagtgcaatctatatgagcttggtgaaatgactgttcttaattctaagttctat
aataactcaatagacataagaaacatctataacaaactcactcacttggaggagcaatatcaaccgtgcaggatttgtcacaatattcaac
tcaagcatcagcaataattcaatcatcacaaactaattagcggaagttacggcttcgttcgtgattcaaataaggaacctccttcagatagaaaactccacaatc
acaataaacgacaacataaatgcaagctctgtggagaattcaacaatctacaatctaaaacgcaattcaatctgataaactctaagatgaaaac
tcaaacaacaatataaatgcaagctctgtggagaattcaacaatctacaatctaaaacgcaattcaatctgataaactctaagatgaaaac
aataagataaagacaattaagaccaatctcctatgtgtcttgagatcagcttattgtaaacagcagcttcaatctgcaaacagagttaaa
ggccttaatatgacttccttactctgcaatgaatcatcttccgacttaagaggaggaaggattggttactgcagtaaagaatcaggaagctctggagcttgc
tggcatttgcattctactctgcaatgaatcatcttccgacttaagaggaggaaggattggttactgcagtaaagaatcaggaagctctggagcttgc
atgggagacggcagcgaaaacagatccattcaatgccgctctaaagtttccctaccacagtacatgagttgcacttgcttatctcctcactgatgcattatacatacca
aacgaaacagacagatccattcaatgccgctctaaagtttccctaccacagtacatgagttgcacttgcttatctcctcactgatgcattatacatacca
ttgcgtcttggagcattggacaatgacaatccagataccaagacgctctatcctaagtatgtgtctatattgtgccagtatattcaaatatcattaaa
gcaaattccaaatcagatattccgatatcagcttcaatagagacatctgctctcataaaaaacagctgctgtgacagataacaattcagataacatacagttcaaatcagtcagttcgga
tttaaggacactccacctgagacgctcatttgcagcttcaatagagacatctgctctcataaaaaacagctgctgtgacagataacaattcagataacatacagttcaaatcagtcagttcgga
tatgacgcttcatttgcagcttcaatagagacatctgctctcataaaaaacagctgctgtgacagataacaattcagataacatacagttcaaatcagtcagttcgga
tactatgacacattcggcaatacatttgaaacatatgagatttatacctatgagattccacatatcgagattccacatatcaataactgtaaacatcactgtaaacaacatcactgtaaacaacatcactagcgga
cctttaaatgcctttgccttgcctttatcctagagatccacatatcgagattccacatatcaataactgtaaacatcactgtaaacaacatcactgtaaacaacatcactagcgga
aagatagtgggagcaggcttccataacaataaagctaagcagacagatatgttccattaacaaggagacacattcagaatcagatcagaatcatagtaaagcttaca
acccttccactttattccacttaattccacttgccgttgagacaataagctcataacaaggagacacattcagaatcagatcagaatcatagtaaagcttaca
ccagacggtaagacatgtgcttaaggcatatactgtcacttgccgatgatagctctaaaacaaggctgtaaagttctatgaggatttctatgaggatatatcatcaaacagtgttcctttagacaagtctatagcatcgtgtcc
gcaagcgtttgccttaaggcatatactgtcacttgccgatgatagctctaaaacaaggctgtaaagttctatgaggatatatcatcaaacagtgttcctttagacaagtctatagcatcgtgtcc
attaaacttaatctcactgtcactaaccgtggggatttgcaagcaattcattacaatgaattcaagatgttaacattaaagtatcagcaaacagctct
tataagatatctgaaaatgagagtctgtaagctatatgtataacttaatctcaaatatttctctaaatataacataagcccctagcaaataagagtgcaaatttgcaaataattcaagcaaagttgcaaataaagaatgtgaatctttgctcttaagtta
tatttggaaaatgagagtctgtaagctatatgtataacttaatctcaaatatttctctaaatataacataagcccctagcaaataagagtgcaaatttgcaaataattcaagcaaagttgcaaataaagaatgtgaatctttgctcttaagtta
tcatgcagcgtaaagcaatgtcttaaacttacattgttgatactaattatatttatattgaatcttacatttggagaatacctattcaagcttcattgatgaggacaag
gcaagttcttatggctctatggctctaaacttacattgttgatactaattatatttatattgaatcttacatttggagaatacctattcaagcttcattgatgaggacaag
gatgatgaggaagatgaagactttaagctaagctacagtgtacagtacaaattgaatcttacattgggagaatcaactaagatccttttgtaaggacatgtaacctattcagtc
accttaaaaaccaacgcaatgaacttcagactacaattattccttaaacataacaaggaagaaactttcacattgacagactgttacagcaagactgtgacgatacgctatgcagataagcttatccaaatt
aattatccaagctcagactacaatttccttaaacataacaaggaagaaactttcacattgacagactgttacagcaagactgtgacgatacgctatgcagataagcttatccaaatt
gttgcagaggtggatgaagaagcggagaatacttcaattgcacattgacagactgttacagcaagactgtgacgatacgctatgcagataagcttatccaaatt
gattcaatgaaggatatataacagaaccactgttccgaggcaaggctccagataaaccttaagaatcaaatgcttacacatttt
gcaatctgttcctaagcgatgatgactattatgcctcatttgaagtggctaagcagcatcgagtagatggtaacaataatcaaatgcttacacatttt
aataaggcttataaggcctctgaaaagtcaaagattctaacagactaattcagcgaagatcgcttcagtcaggtaagcttgtctagcaagaagttattgact
tttacagtcgatgaaagacctattcagctaagactaattcagcgaagatcgcttcagtcaggtaagcttgtctagcaagaagttattgact
ttcacagtcaaattcgctggagatgattgttatggttctgctaccaagtctgcgaaggtattataaatag
```

FIG. 5B-14

ORFs selected for antibody production: Amino acid sequences.

| ORF | SEQ ID No. | Amino acid sequences |
|---|---|---|
| Contig40_gene_697 | 10 | mdqviaclgavcailwgvlairsvasyglgtgvpsigymslgigvigalagvgiiaafklkglemlgpilalvfamligllvaivakkivgmk ipvmerctaeiagaalavlgfssaiaggysidllltavvapgfialfyilvtmaiqhpfnaclgpnedqvrtlkcgastafltmiitgilai saggyawfailvvgligwyvsfkmfvnasyeaaasvkwsglwpkvee |
| Contig40_gene_698 | 11 | mdllificvviagiimggvhfipvggapaamatatgvgtgtamlaagagltgtlitaasmtgpvwlivlagavgsmiumgjtmlignfiyi fgvgvvpasgkaavdpitgwnqekyktpgteghgiptvcyisgliggllggagglvywainefatanltgfdatviaglaailsvgmffins vtasyniggtiegfvdpkfkrlptgilacavvslvaafmvlmiggi |
| Contig40_gene_699 | 12 | mdpitlgvalmgaaatiagaaedlesdigsqsnpnsqvqlapqmghlhrminkaasgepvaygcwcgisgaaialamgmgiipivaiamgst vaalvhaiytvtshmgrivggsqfeqplfmdvltqslgpiaahgfiasfgviagiaylmtlpldglghpfplpllavlwgitigaigsstgdvh ygaeseygkfdyggtpvaiggdivtkaplgaknsidvgnfcakyggpltgfcgflivfvsfwitvvfgalgggivgivilliaanyllek strakfgpyee |
| Contig40_gene_828 | 13 | mkynkkifflllclliipqaiyagdvddlsdagnytrdnspltisstygssdggyddkneniyildkvsdgdkskccskdlsldnac smdksscsksnsacskgissdkdssnlsntylvsennyndfnvdidlndklsdldlnndlsinkdltinlnsnndmdylnleevigtqtlty egdldqtylndeslngdvgnddslnkndlksplsdentfnifiisdntgnnlfdavaceildnsnfsnvkfnirsgnginamsedeiyelmap cdafigqwvssnvdavltslllnnhpelsnkklfllileptgninsssslnlvrnstidykkifngisnddlinyfkatkrgnnfesiqeyid negssfnsifnnlvlykdindkanlknellyilyllghgcsyesanftgvqasgifrdrwysfdeyvltffnesrnrtigilestmyiqsqql dlvneiterleskgynviplycpagnaeqlnimvkywtsacsnisgflenpqdfdiyvdgiismvaygvggenftnatkffedanvpifravh seyitneqwelspvglsttksdkwwhvtiaesqgifdatyvgvdsyisnrtgaliltfvpvheniellltdrvdawvdlkytpnedknisivy ynyppkqnigasyldaitsvynmlytlkdegyyltdlpnnvseledmmiacginvanwapgeveklanrsgvallpvdeylewfdslddivk vqiteqpvayigqmvrravlinytdevetmvndwynqikallpenqtvaatnildklvnsiklyanassdgdenaslyydeflryydefksln vsglngweapgnimlvnrngtdyfvipgltfgnvfigpepgrgweadienlyhctavapthqylaayymqtrqsnamvfvgrhathewlpg kevllsyndygsivvgkvpqvfyitdglaeaiqakrrgfavlishldspksythlygnltvlatlleeydnnhiiesdsdkdnqaityqvi kdnqtityqvinqelednltraikdlviannyyltigftaeelnntdmfslsstlnaflkntqntlyplghaigqkwtdedlantvailvsh dfeyggkktnlfdqlslyyygeksynltpqvlptganmyqdqsselptqkawdyaktlslltladindttekilmgiwcvetarddgalvstvlyllgmepvwh lnggyvpvniggesvtvpqvlptganmyqdqsselptqkawdyaktlslltladindttekilmgiwcvetarddgalvstvlyllgmepvwh nssagfdeegiptgkkvedlpnvialenltrpdgwakkridvtvitsglfrdlyssqarlmdnayrmalacsyytivnnktimdseygpqvy dalrsimrsisfkgmsnesledynvakhwledciyyslgynstvsgeyaitrifappngdygagisklvsmswtwndtdelsefyigrmgnm yskyywgdtnpvvfmralsdtdhivvsrntnqygvldnddffdywgglsmtveylsnktptmvlmyankdnayvatfenvfynelntrylnp ewikgmmqegysgsrymsnkfisnlwgwqvtrpssvsetvwddvyntyykdkygyglgvkswlqsgmnayslismsgtmlnsaysgywdaddatl sdiantwaqatvangvaccdcscgnvanmqwafkyvnadllaklmpklydatqnplfytnssdmptnssnidrrtnssaesnntetvqtnss snsqsangtnipgasggymvgteadaqsdmasdsdagmndangegrsvevtkststpvapkdvsmpialivcviclvaligfgyfrnrkdd ddynddddyeyk |
| Contig40_gene_829 | 14 | msfgavsaadlntvqsgevsggvdiassnpgvengeltyeipdsveniqyaglfvdsytagsnlvygseanitltkngeseqiaserlvasv gsadgevyvindhttkcfadymtynltdrlqdakgnitivnatpiegytfynkikliglvftyddgdgqfhywvnagsswvktdsgetsk atfklgnvnydptvatldnfalssgdgvytfngkemdesivtetgvyyyihhkfdlldkinmtnlvytpgegsyysfrnvlsvvklvktvpv |

FIG. 5B-15

| | | |
|---|---|---|
| | | yakvnisseyddivfsgtenllkvgitnngtgsasylldlyadgkkvnssqislaagreavislidntirpsaadtvsgadnkkinytvvvsd
kntgevldessifpnllyngylgkglaypaekissfknitvngmlieslgdstyldasmtgktdswtidlpdgafftdafvypnldngnv
pmftstfngaavnpiasyrdqpnigenakngyllvydvgelikagvnsfalskeagiagvypstliafynltdsdlltsafifngadllsne
ynslgrdvssdnilsigafdglvsaklhvfaadcqagegdltvngksyknwagtnrsvgdyvvdlgkstnasnevsfistasnilalqqlav
vqynvpsvkaslvseysnavfagtnnvlslnitnngkfdsiytvdfyvdgkkqnsteislksganiglyliddtirpidastvngadnpkvny
tvviidkeksmvldeititpsllyngnlgkdlaypaenitsfrnitvsggvivdtlddstyinsqatnrtdiwnvnadgdvftdafvypyn
wdktngympvwnarfngvavsplvsyrdqsnigffgkngyglvvydvskliksgentftlekeagitavypstlmafynatssnslktiyiyn
gadllanennflnrtvasdshldissfkevisaklyvfsagaqkgegniifnnktykdvwngtvnsvdsfiidlgkspsvsndvsfvstgsti
malqqlivldyvvssvkanvsseysgavfagtdnvlkvdltndqgggsvyvldfyidgkivnsteipldagksteiflvddkirpvdastvng
annakvnytitvtdkasglvlyeaslnpivlyngnlgkdlaypaenisffdaitvnggviidctlddstylgakttgrtdvwkveipkdgkivd
gfvvysynwdktngsmpiwnvsfngvvspvahyrdqsnnqlygkygyglvvydvgeliksaenkftlekengttavypstllafynrtesnn
rttvymyngadllsnannflgrtvasnaaldlalnpndeikssrl

FIG. 5B-16

| | | |
|---|---|---|
| | | afagtnnvlkvntnvaeedavfnvtlyadgveigsqlievgaygsaiamftdekirpvtentvkgadnekvnytavvrdvddlvedaeatit |
| | | pdilyngnlgkdlaypaeeitffdsitvnggiyieiqndssylasgatnrtdiwnieapedadfvagfvyvaynwdktsagipalnitfngvs |
| | | vapvahyrdqsnmgtygkygygllvydvsdlleagdnvftltkdanmtaiypsvlvagydqevsdsmktiymfngadllsnannflgrvvasn |
| | | svldielpddvidcalgifaassqkgegnlivngesfedvwngssnsvqacvfnltddieesntvsfvatgstilalqqfifveyelvsvdak |
| | | lgseynnvafagtdnvlefnitdgtiptayfiefyidgeladtlelelangesdslylvdptirpvdettvngadnakvnytvvitdnstgd |
| | | vldititpsvlyngnlgkdlaypageitffdvitvngdiivigmndstylgskttgrtdwdlttnediifaagylyvaynwdktpagmpvw |
| | | nttfngvtvtpvahyrdqsnmgtygkygyglivydvsdlivagentftlekengttavypstlvafynmpesstyttylyngadllsnannf |
| | | lgrlvasnstldidsfdnivgadllvfaasaqagegslvingdlvadiwngssnsvdayaidlgknpkasnevsfvatgstilalqqfivvey |
| | | nvpsaeaslvseysnvafagtnnvlqfnltnngaintsyivdfyidgkkvnstqialnsgesfgqyfiddtirpvdastvngaanavnytvl |
| | | vsdkdtglildevtltpsvlyngnlgkdlahppeeivlfdtitvngdviidtlddstylgakttgrtdewnltvpsdadfevaylyvaynwdk |
| | | tasgmpewnttfngvntpvahyrdqsnmgtygkygyglyiydvsdlikaglntftlgkengttavypstlvalyvnvesnvlttvslfngad |
| | | llsnannflnrtvasnnvleldftvfdeilssqlyfaasaqagegnlivnnetftnvwngtsnsvdayivdlgndpsisndvsfvatgstil |
| | | aleqfvvvkskygtssdiqklidaaepgstldlgdnvfqdvanvvidknltikgssimgkagetifvipaksangpdevnitgvdfivedanv |
| | | ivgatadngssptsidtpnirisdnfidmidgsvvpesvtvlkldsergvlaptgelkvtdnaiaagikpfefdvtgvsngsdtnipeggnip |
| | | akqasvihyqdmettavnskiegrvgkyfevnltdtngnplankfvqigfngvvynrttnetgvklqinlgykgtyfaisylgddyyngsf |
| | | vvskikvstqntklttaaktykasaktkltatikssvynkpingkkvtftvngksysattnakgvatvkvslstkktysftakfagddmytk |
| | | ssvtgkvtik |
| Contig40_gene_115 | 16 | mkvlkiaiimlliliislgavsatenfnndlsdnqlndntlsdnslnentlsdntlsdkslsestiiqndhdnlkdtnnndnnkalkdpaktft |
| | | dlqmeiinasdlleltddykynnetdnitltisksnfvingnghtidgdnqcgifqingtnitlknlninanstkdsallnpgseletnnv |
| | | tfindssdkrvifafgakytsnndkfidctslndgvinsylgeitinngyfesskpldwafvnslgnssiyvlnttfanttskyataikgdre |
| | | tvihdskfinlyanltagaiglkrieeaeidnctfinvssqknggailfdsdisalilncsfsnnnaqtggalytydsgyyianstfkdntnkeseefd |
| | | nngaffdggaiyssfsqltisqtifdnnsveldddrgsfggaifsdisalilncsfsnnnaqtggalytydsgyyianstfkdntnkeseefd |
| | | diftdfdgeiatlennsysgedsiclnneryesviavsgmnftlieneinvtnpprkfdlrewgwvtpvknqgymgscwafgtvgaiessilr |
| | | flglemdisennqdsllqyyrygtlgaeeggeynlgpsyalswfgvfpseydvdelgkisaiiatddsihlqdavfvpplmnstdkdklkq |
| | | sllkygalavsyyaetcepglnentssqyslkndsnhrvllvgwddysdknfymtppgdqawiiknswgeelgdkgyyisyydasfatlvp |
| | | svgfpimntviynknyqydiggtleftdmgneyvnefealeddfiaavgtyfidagvdynieiyvndelkysqdgtspffgfhtiqldsyvpi |
| | | kegdefdvkitscciipilesgrqhyienksaanlngewdltsdgkvcaikvyttdedkkkessrintridcknmttavasedgrigeyfqv |
| | | tlkdengtalankpikigfngrvydrttdengsaklqinlaykgtyfaigflgdeeylgafevakitvkvqtpkltapnksykvsaktkslt |
| | | asfktangkavsgkkisftvngktysaktnskgtatvnvslnkkgtysftvkfagddtfatssakakltlk |
| Contig49_gene_43 | 17 | mrlryfaiislilliflvpvsfasetnldsielndladssteiddstdlnqdyssnqdlslnqnsdsnlsneqelysnklsensldsnsqssn |
| | | dlsnslylssngvrladlnssfaqfntslndsntiyvnssyigsdefgtqsnpyktvlaginaattdlnnvyiangvyninttitvlksinii |
| | | geslnvilnasnennilsvkgssvevsifnltfrngyankggaiyvdksslniigslfdsniayvtsdngyggaiynnagflklynttfknnk |
| | | vvaaynivsegfggalynelgemtvlnskfynnsidirnisksssygaggaifnragfvtifnssisnnsiytnyslggaisiwasrnvyiins |
| | | tindniisgsygfasvisnkgtllqienstisnnninassvenstiyningnfnlinskmennkiktknllmcledqlivnssfnlanelk |
| | | qlnmtslpshydlreeglvtavknqgssgacwafaysamesyllkvenisydfsennmkncmgdgsenstdwddgayvalayllrwsgai |
| | | netddpfnarskvsptnltrvkyltdalyiplrlgaldndqiktailkygaifvpvysniikansksgysdiqyicnhavaivgwddnysasn |
| | | fkdtppgdqafiiknswgtsggegyyyisyydasfaasietsaavatnvvnttgeyrnnyyydtfgntfetigynsdtiwfangftaisdn |
| | | plnafglytygdstytvnitvnnksvytssgkivgagfhtiklsryvpltkgdtfrliivkltttpstlfplavetnysgftpraksdyngsfis |

FIG. 5B-17

| | | |
|---|---|---|
| | | pdgktwydlrnssnnravkfyedmyfytlknasvclkaytafadelelnlssnspiyytgdtiklnltvtnrgdlasnssiavpldksysivs<br>ykisenngnksydihyngssfnmasgiwsipyleneesvslilslkmnsnndvnikvsanssscsvkdnvyanislkykipskfanipsintt<br>arsygllnftlldinnkplanknvnllllklddeededlslndtnlyysdssisnasvisnltlktngngivqyklnltlgeylfklafdedk<br>nyqasdynyslnitkrkstkilckdmvtysvvaevdgrsgeyfnvtltdcdgyamadkfiqigfngriynrttdsegkarlqinlknpnaytf<br>aicflsdddyyasfevakitvnkkkmslnvpnkaykasekskiltatliennkktvankllтftvdgktysaktnsagvasvkvslsskkiys<br>ftvkfagddcygsatksakviik |

FIG. 6A

ORFs encoding methanogenesis pathway enzymes identified from *M. ruminantium*: Annotation.

| ORF | ORF Annotation |
|---|---|
| Contig40_gene_238 | formylmethanofuran-tetrahydromethanopterin formyltransferase FtrII |
| Contig40_gene_692 | tetrahydromethanopterin S-methyltransferase subunit H MtrH |
| Contig40_gene_693 | tetrahydromethanopterin S-methyltransferase subunit G MtrG |
| Contig40_gene_694 | tetrahydromethanopterin S-methyltransferase subunit F MtrF |
| Contig40_gene_695 | tetrahydromethanopterin S-methyltransferase subunit A MtrA |
| Contig40_gene_696 | tetrahydromethanopterin S-methyltransferase subunit B MtrB |
| Contig40_gene_697 | tetrahydromethanopterin S-methyltransferase subunit C MtrC |
| Contig40_gene_698 | tetrahydromethanopterin S-methyltransferase subunit D MtrD |
| Contig40_gene_699 | tetrahydromethanopterin S-methyltransferase subunit E MtrE |
| Contig40_gene_700 | methyl-coenzyme M reductase alpha subunit McrA |
| Contig40_gene_701 | methyl-coenzyme M reductase gamma subunit McrG |
| Contig40_gene_702 | methyl-coenzyme M reductase C subunit McrC |
| Contig40_gene_703 | methyl-coenzyme M reductase D subunit McrD |
| Contig40_gene_704 | methyl-coenzyme M reductase beta subunit McrB |
| Contig40_gene_802 | formylmethanofuran-tetrahydromethanopterin formyltransferase Ftr |
| Contig40_gene_925 | F420-dependent methylenetetrahydromethanopterin dehydrogenase Mtd |
| Contig40_gene_1365 | tungsten formylmethanofuran dehydrogenase subunit E FwdE |
| Contig40_gene_1366 | tungsten formylmethanofuran dehydrogenase subunit F FwdF |
| Contig40_gene_1367 | tungsten formylmethanofuran dehydrogenase subunit G FwdG |
| Contig40_gene_1368 | tungsten formylmethanofuran dehydrogenase subunit D FwdD |
| Contig40_gene_1369 | tungsten formylmethanofuran dehydrogenase subunit B FwdB |
| Contig40_gene_1370 | tungsten formylmethanofuran dehydrogenase subunit A FwdA |
| Contig40_gene_1371 | tungsten formylmethanofuran dehydrogenase subunit C FwdC |
| Contig47_gene_224 | 5,10-methylenetetrahydromethanopterin reductase |
| Contig47_gene_269 | coenzyme F420-dependent N(5),N(10)-methenyltetrahydromethanopterin reductase Hmd |
| Contig47_gene_358 | tetrahydromethanopterin S-methyltransferase subunit A |
| Contig49_gene_209 | methenyltetrahydromethanopterin cyclohydrolase Mch |

FIG. 6B-19

ORFs encoding methanogenesis pathway enzymes identified from *M. ruminantium*: nucleotide sequences

| ORF | SEQ ID No. | Nucleotide sequences |
|---|---|---|
| Contig40_gene_238 | 711 | atgtaaattatgataaggttgaagatacctctcttgaatcatttgatgaatgtatataagagcattgattacagcagaagacgaattgact gtaaggaagcagcatatgatgctacacgctactccaagtgcagttattggcaggttgcagggttgaagtgttgagaatgtccttgtaagtggataag actccagacgaaggcctgagccattgttcagttctggcttaccgatgactggctaagttgaaaagaactgtcctataggattcgccag gacattccttgtaaagccattacaagggtattcagcataactgaaaatccgtaggttcaattcctatgatgaaagcgtaggccattgcggt gacggctatgaatggaatcatggaggagtatgaagaagatgatcaatgtctcattgcagttccgatttcaaatcgagtcagagcttgct tatgcagaaggaatcatgggagtttgcacctccattgaattggtgttctgcgaaggctgtattgaaggcaggagaataataaagaccatt atggaagttgatgggtctgcactccattgcttaaggaaagactggcaaggagtcaaaagttccagaaggagtaaactatattccagagttgtcagcactaat catccttattgtccttcttttaaggagagcatgaacttgctctattaagaagctgttgatgccattagtagtagtcagaagatttcgctgaaactt gtaagtcaggaagctatgaagagcataagacaattgcttgtatatcttaaggaatga |
| Contig40_gene_692 | 712 | atgtttagatttgataagaacactgctcgtagatattgctgagtaaaatgggaggacaacctgagaatacccctaccgttttagcagga acatctttacgcgacacaaatattagtgatgaaaagcaggagacttgataaagacgctgcgaagatgatgtaattaaaacaatgaa gaatgtctgatgtaaccggataacctttcgttgttgtacaaacttcgtctactgcagaagctatgttaatatcgtacagaattagatttgtagggac atctgtgacaaactttcctatcgactcaactgctcagctgcaaagattgcagttgtagaatacgtagctaactctgactgcaccatcttcttaggttc gctgtatacaactcctaagatgtgaccgtgtacctgtaaactcgaatctggaaaccggtgatctgttatcgacgaaggtattctcgaatgcagaaaga tgtggtattacaaccctggatgagcagttcgtattcacaacatcgtacaacaaatgctgttggagactcgtactttcggtcctatcgaaaactcagctcgcattc ccagcatgtgtggtatgcagatattatgattgctgaagcagcaagatactcggtaccgaaccctattgaagcacccattgaacttgtttatta taa |
| Contig40_gene_693 | 713 | atgtctgaagaagaatcagtacctcagtaccctcaaattattgtatctcaccgatgatatgcagctgcaatattggaagctgaagaaaagta gaattcgctgttggtgatactccaacgtttaggacaacaaaacggtagagatattgatttttttattgtattttttgttattttgagtcttgtaatt ttaatagtatctattgaatttggtttggtaagtgcaatgagtactatgcttacaagcttagtctaa |
| Contig40_gene_694 | 714 | atgttagatttcaaacaaccaaatactcgtggtagtagtaagcttctaataatgtagaataccgtcgaaagctcttagtagagaagga agattatttgctgctgactcagcaccagattttctgaatggctattgtattgatttagctcttgcttagcagttgttattccatactta gctaaattatgtggttatag |
| Contig40_gene_695 | 715 | atggctgacaaaaaacctgctgctgataactgctgtagtaagtggagactacattgtaggggaccctgaaagtcctgttgctgtaactacc ttagctctcacaatgaagatattccagctgctgctgagcagctattgctgaacctgtaagactgaaaactaggtattgaaaagttgtt gcaaaactcattttcaaaccccaaatcagattctttaatcctttgtgtgctcaaggtcacattcgtcaaagtatccaagcatta catgaaaatggttgcgaccctgaaaagaaaacttgttgacttgatcgacaacaggtggcaatcacgaagacgtggagcaatctcctgaaaaacattcctagaggtgagaa agattccaacaagtagaaactgctgttgacttgttatgttattggagtgaagatgctatgttattgtgatgttgaagagatgacgaagagtgaagatgagaagtatgcagaaagat cctgtgctttgaagaggatgctatgttattgaagtgaagaagatgacgaagagatgaagttgaacactgtctctattttccgct gaaactgcattacttgaagcaagatcagaaacattgacactcaagtaaaattagttggtgctgtacaagaaatatgcaggtaactattca |

FIG. 6B-20

| | |
|---|---|
| | ggaaagtccaagtatcatgattgattaatattcacttagtaatcgtttcttgttattaatgcaccattattaggtgcataa |
| Contig40_gene_696 | atggtattacctttaatacaatttattcctgaattaaacttaaatctgatcctgaaaccggtctcttctcggtgcaggtggtggagatttaatc<br>atcttcaatggatgagataaatggagaaatcgaaaagtcgaagcggctgctgatgaattaatgaattcctagatccttaatccgcacca<br>ttaggttcctccaagagacaagaaggtaactttgttattgcaggaacaatgaccaatatggtttatgattatatagaatgttccttatc<br>atggcagcaatgcctatattaacagctatggggtttatag |
| Contig40_gene_697 | ttggaccaagtcattgcatgtcttggtgcatgttgtgcaattcttgggagttcttgctattgtagtgtagcaagttacggtttaggtact<br>ggtgtacctctattggttacatgtcttttaggtataggtgtaatcggtgcattagcaggtgtagttgcagcattaaattaaaagga<br>ttagaaatgctcggaccaatactgcattagtattgcaatgctcattggtttattagttgcaatgctaagaagattgttggaatgaaa<br>atccctgttatggaaagatgcacagctgaaatcgctgtgctgcgatctcctgatctcctcctgcaattgcaggtgatactct<br>attgatttattattaaccgctgttgtagctcctggtgctccttgctctcttttacatatagttactaggctatccaacaccattcaacgca<br>tgtttaggacctaacgaagatcaagttagaactcttaaatgtggtgcatccactgcatcttaaccatgattattactgtattctgcaatt<br>tccgctgaggatacgcatggtttgcaatttgactgttgtgactatcggctgtacgtctcattaaaatgtttgttaatgctcctacgaa<br>gctgcagcatcgtgttaaatgtccgattatgccaaaagttgaggaataa |
| Contig40_gene_698 | atggatctttaatattattattatgtgttgtaatgcaagtattattatgtggaggtgtacactcattcctgtagtgtgtctcctgca<br>gctatggctaccgctaccggtgtgtagaactggtaccgcaatgttagcagctggtgcaggattaactgacctaattaccgcagcttctatgacc<br>ggtcaaccagtatgttaatgctatagcagtgcagttgcagttgttccatgtaatgatggtcatccacatgctattgtaacttcattattatt<br>ttcgttggtggtagtaccagcatctgtaaagcagcagtcgacccaattactggtgtatcacaagcagccaagaaaatacaaaaaccccagtaccgaa<br>ggacacggtattcctacctggtcgaaacttaactggtgtatcataagcggtgtattcatcgtgttatcgctgttagcagctattctctgttgtactgctactgcaattaat<br>gaattgctactggtcgaaacttaacacattgagttactattgaaagtttcgtagaacctaaattcaaaagactcccaactgaatcctcgctgtgtctgtt<br>gtaactgcttcctataacattgagttactattgaagtttcgtagaacctaaattcaaaagactcccaactgaatcctcgctgtgctgtt<br>gtttctcttgtagctgctatttcatgtgttttaatgatagaggtatttaa |
| Contig40_gene_699 | atggaccctattacattagtgtagtcgcattgatgggtgcagcaaccattgcaggtgctgcagagacttagaatctgacatcggttca<br>caaagtaaccctaactctcaggttcagctgcgtatttccggtgctattccggtgctattgcagctcttgctattgcagctctatagtgcaatgcaatggtctatgcagcagtagca<br>tacggatgctgtgtggttaatgctcttccggtgtattccggtgtattgcagctcttgctattgcagtacagttatacagtcacacatggttcttgcttgctctat<br>gtcgctgcacttgttcacgcaattttatacagtcagctcatattactgcgctatgcagtttataggattgtcgtcaatcaattgaacaacattattatggac<br>gtattaaccaatccttaggccccatcctatcgcagctcatgtgtttataggtactagtttcggtattgtaggaatcgcttattaatgactcttccatta<br>gacggacttggacacccattccattaccattcgactacggtgaggtactcctgtagcgattcaagggatatcgtaactaaagctcctctcggt<br>tatggtgcagaaagtgaataccaaaaattcgactacggtgaggtactcctgtagcgattcaagggatatcgtaactaaagctcctctcggt<br>gctaaaaactctatcgatgtaggtaacttctgtgctaaatatggtgacctttaaccggattctgtttggactttgtttcgtaagcttc<br>tggattactgttgtattcggagcttaggaggacaaattgtaggtattgtcatcgttatttattaatcgctgctaattacttacttgaaaag<br>tctacaagagagcaaaattcggaccatatgaggaataa |

FIG. 6B-21

| | | |
|---|---|---|
| Contig40_gene_700 | 1374 | atggctgataaaaaattcttagatgcaatgactaaaaagttcaagaagctccagagaaaaactactaccttctatatatgggcggttgg<br>actcaatctgaaagaaaaactgaattgtaaacgaagtaaagcaatcgctgaagcgtaccaatgtacaacccagacattggtaac<br>ccacttggtcaagagcttyaatgtcctaccaattatccgtactgacactttgtagaaggggacgactracacttttataacacgcagca<br>atgcaacaagcttggacgatatcagaaaactgtaatcgtaggttgtaaaccacgtactgtgcaaaaaaggttaggtatggaagta<br>actcctgaaaccattaccaactacttaagaagtatttaccggtgaaccacgtgtgcagctgcagtacaagaacacatgtagaaaccaaccca<br>ttactcgtagacgactcctacgtaagaacgtgaagctggacgacgctattggcaaatrgtaagagttccatctgttgtaggtagagtc<br>gagttccgagaagaacaagctgaagcttgacaacctccagatgtctgctatgtcatggaagttatgtctgtracttactaccgacgaactcgt<br>gggtgactcccattcgattcatggcgagatatctgtcagcaaccagagtaaccgacgaccctgtagaattctgcattagaagtagtcgt<br>gctgctrtatacgaccaaatctggttaggtctctaccatgtctggtggtggtggtagattactcaatattgctaccgcagcataccagcataacgta<br>t |
| Contig40_gene_701 | 720 | atgcacaatatattatccaggaacttctcaggtagctgaaaacagaagaaaattactaacccagatgttgagttagaagttaagagaaata<br>tcrgatgaagatgtagtaagattattaggtaaaattttgcaggtcacagagctccaggtgcaaaagcaggagtagataacaaatccgttcacccacctctgargaacct<br>gatgacattattagagaaccttgtgagacctatcctacgtatacagatcctaagaagaatcggaatacactttgtagactccatgtacttt<br>gctccagctcaacctttaagacgagaatgtagaagaaatttaagaaacgaatacttgacactgcacgtacctratccggagacacaaattatcgaa<br>gctcgtgaaagagatgaatgtgagaaagactctcttaagaaacgttttaatgttgacatgttaagagacaagtacttcaacaaagaaaccgtaacgttgaaatg<br>cacggtcactctttaagactcgacgaaacccgttaattgtcgtgaattagacgaacctgtagtattaggtgaaccattaggtaaccattagacggaaccttcagagctaaaaaccacaa-cta<br>gtaaaagaccaaattggtcgtgaattggacgaccgttgttaaccttccgaattaatcatgaacataagctaaatattcagggtaccacctcaagagcgtaacgttgaaatg<br>cagatgtga |
| Contig40_gene_702 | 721 | atgattggaagtgcacacatctgtagactgcaggagaacaagaggaccttggtgaaggaaggaattgccaagagaacttttgcagaa<br>tgtggaagcgatgttttgcagttgcaatgtctccaggttgcaagtgatgtctccaggtgaagaagacaccagtcgtgaaatcaccttcgtcttgcgaagcc<br>aacctattgaccagccagcatgtatttgatgcagaaggcgtaccgcatgatgctcctgctgaggtgccgtaatgcattcggcttgact<br>gacaagcagaagtcgagcagagtcgacaaccttgttgttcaaagttcaaggtcattgttgaatatcctgtagactttgaagattttgcaaaaatcggtgtcaaaaccgcaaagtc<br>tagcgtaacgtcaacagaagacagaagacgtaaagcagaagtaaaatcatgaacataagctaaatattcagggtgttattaggggacaacaacagtctcaagaaaattagatgag<br>atgcctgatgaggtaaagacagaagacgtaaaatcatgaacataagctaaatattcagggtgttattaggggacaacaacagtctcaagaaaattagatgag<br>attattagaaaagttagattaacattaggagatgcataa |
| Contig40_gene_703 | 722 | atggatatrgaaatatttccacacagaattttagtacagacacaactgaaaaggtattaaatgattcagattcagttaaaaga<br>actgtaattcaaggccaagactcccacacaagatgagattrgacagaatgcagaatcattgtgatcgcagaatcattgtggtaaatgcgaagaagtt<br>gaattaaaggttaaaactgtagaattcgtagaactctatrgatgaactctatcgraagcaaagaatttagagcaatatagccatatgcataagcatattgac<br>actgttttgatattaatactagcaaggtcgcagataccgttctaaattaatgaacatgrctctattctaagaaaagatggtctgaataa<br>cctgaagaactgattggtatcgcagataccgttctaaattaatgaacatgrctctattctaagaaaagatggtctgaataa |
| Contig40_gene_704 | 723 | ttggcaaagttgatgataaagtgatcgatttatacgacgacagaggttcattagtcgaatctgatgtaccaatcgaagctcaagtccgtracgt<br>aaccctgctattaagaacattattagcggtgttaaaagaaactgagctgtaaacttagaagtatcgaaaatcttaaaactgttccgtt<br>ggtggagcaaaatctaaaacttagaagagaaatggatcttgacattgttgctcaagctgactccattaacgcttcttaaaagaatgctt<br>caagtaactgagacgatgatactaaatggaaatactctcrgtgtgaaaaagttttgacgtaagcatrtgacgacgaaacatgctt<br>gcagaatactccgtagcaaccttagctacgcaactgcatrtaaccaaccaagctatcctctcactatcgattagattcttcc<br>gtaaaagctgctatcctagaagatacaaacctgtagaatacatggatcaacttaaagaattagacgaccaccaaaattagaa |

FIG. 6B-22

| | | |
|---|---|---|
| | | ggtccaggttactcttttaagaaacattaaagcaaacgacttcgtagctgctacctttaaagaatacttacaagcaactgctcttgcaagtatc<br>tttgaacaaactgctatgttgaaatggtgacgcagtcggtgcatacgaaagaatgcacttattaggtttagcttaccaaggattaaacgca<br>gacaacatggtattaggtctcgtacaagacaagaaggaaccgtaggttctatcgtacaagacacccattgctaaagctgaagctgat<br>ggtgttatcgctgtagaaaaagaattaaccgactacaacatgtacgcaaccaacgatgcagctaaatgaaccgcatacgctgctgatgt<br>actgctgctattatgttaacgtagtgcagcaagagctgctcaaggtattccatctactatttttatacttcaacgacaacatcgaattcgct<br>a |
| Contig40_<br>gene_802 | 724 | atggaaattaatggtgtagaaaattaagaaaactacgcagaaggattcgaattaaagtaactagaatttagtaactgcagcaactgcaaaa<br>cttgcaaaaattgcagacggaagacctggttacgcactcagtgttcaacttctgtaatcgatgtcctgctgaagcaggtattgactgttttgtaccatct<br>gaatgcactccagacggaagacctggttacgcactcagtgttcaacttctgtaatcgatgtcctgctgaagcaggtattgactgttttgtaccatct<br>atgtgtgtcttaactgctcctactgcagcagcattcaacttactcgaatctgaagacgaattaaaaaccgcttcaaactcaaatacttcggt<br>gacggtttcgaaaaagactgttgcattgcagtggagaaacttcttcatttagctaaaagtacaactccatccaaattactgtgttaaagctgacttcattgtagaatccactttcgga<br>ttcaaagcaggtgtagctgagctgtgagaactcttcatttagctaaaagaccaaattactgtgttaaagctgctcaaatgctgttgcagctatt<br>agaaacatccagtgtactatcactccctgaggtatgttgacctgcaaagtaggatccaacaaatactcattcttaccagca<br>tccactaacgaaaaatgtgtaactttaaaagccaaaagctatgaaaagcaggtattgtgaagctgaagtgtatttgaaatcgttattgac<br>ggttagatgaagaatgttaggtgcataccatctaaactacacgacttattctaa<br>tttgacggtaagttaggtgcataccatctaaactacacgacttattctaa |
| Contig40_<br>gene_925 | 725 | atgtgtgatatatgtgtagtaaaattgtatcgtaaaaagtggtaatatattgtactccaccagtatttagatttattattagacgaaagagca<br>gacagaccaaacatcgatgtaagagtattttgatctgagcaaaaatgaacctgaacaagttgaagacgtcgtacctaaactcgaccaattc<br>gaccctgactctgtattttcattagccgcaaaccaggagcaccggtccagctagagcaagaaccgtttaggttacattattgtaatgtccgaccatgatc<br>attatcattggtgacgcacctggtaaaggtaaaacccggtaaagagtttaaccgctgacatcttaaaagtattagcagaaactggtgcttttaagatta<br>ggtcaaaaagagaattcctcgacgctgttagaccaactcatcagcaaaagcaaaagcaaaagctatcgctgctgatgctgtgcgaagaaattgaattaccaactcattgttactgctgaaaagctgtt<br>gaagctgcaggatttgcaaacccatacgcaaaagcaaaagcaaaagctatcgctgctgatgctgtgcgaagaaattgaattaccaactcattgttactgctgaaaagctgtt<br>tgtttcatgaccaaaggcttcaaaatcaacgacactgtcttaagaactcatcctcaatgttgctgctgcacacgaaattgcatctgctgctaaattagctcaagaagct<br>agagaattgaaaatcaacgacactgtcttaagaactcctcacatgaaagaagaaactaggttgcaaagttgatttaatcagcaaacct<br>gtagacaaataa |
| Contig40_<br>gene_136<br>5 | 726 | atgccaaaacatatcgtatcaggactaaaatatttagaaatattgaacgccaaaacattctgaacgtcatcgacttgctaaagttatttagagctgaat<br>ggtgtggacagatcaactatttctcactacttgaacgccaaaacattctgccgattcaatcgacttgctaaagttatttagagctgaat<br>cctaaggatttatattaattgcaagagtttgttgatgtgtgagattataacgaaattcgtcaacttattagcattttttaatatgaatcattatgac<br>ccgcagatagtagttgacggatgtattgtgcgatgtgtctcttatgtttgaagtgaagtcttagcttagactcattaaaagcaaagata<br>aaccctgtcattgttgtgctgtctattatgtggctgtctcttatgttgaagatgccgacaaattcaataaagatttggaggtataa |
| Contig40_<br>gene_136<br>6 | 727 | atgtgtcaaaaatattaaagaacagaagcaaaacttctgcattaaagatcattaggcagaagagtattgtcttcaaagatcacgtc<br>tgtgtcggttgcgactctgtgaacaacctgtcctgtgaagcatatctctcttgatgaagtagctcctatcgaacgtaaatatgtagacact<br>tatttcagtggtcatgaaagattgctcaaaactgtctcttttcactaatgataacgaaatcaaagcaaaattagatattgcaagataaa<br>tgtgttctctgtggttatgtagtggagtatgtccagcaggtgcattggagactgctattgatggcgtatccattaaagaaaatgaagcttac<br>ccacatcttgtcactaaccgtgcagacttgtccagcaggtgcattggagactgctattgatggcgtatccattaaagaaaatgaagcttac<br>gacagaaattacctaaccgtcagacttgtaaccggtgaagcaaatgtttattctgaagtggatgaagaagaatgtatctactgtggcgcttgtgctgaatta<br>tgtcctgctgaagctatcgtagtggacaaggcaacggcgaagaagcattgcattgacaaggaagaaaatgtgtatactgtctgtatgtaag |

FIG. 6B-23

| | |
|---|---|
| | aagcatgtcctgtttgacgctatcaaagcagtatgtagatcctgtttcctacggcgaatacgatcttgacctgctaaagcagcaattacggt<br>aacgctatcattgattctgaaacctgtattaaatgtgattgtgaaggagtcctgtcctgctgatgcagctactgtaaaacaagcattcaa<br>ggtactctcgaaatcgacgagaaaaatgtgtacctgtggagcatgtattgacgtatgtcatgtaatgtcttgtcctccctaaatcaact<br>ggtcctgagacagaggaactcacttagttaaagaagattactgtatccactgtggtgcttgtcaaagtatgcctaacgaagcatta<br>a |
| Contig40_<br>gene_136<br>7 | atggaacttaaagtagatcaagataaatgtttagttgtgagtatgttgttatcgcatgtcctgtaaacgcttccatcagtcggaaaacgct<br>ggaggacacggttccaaacaaccgaaactattatgatgttgaaaacgattattaaattattcagtgtggacaaatgtgataaatgtggt<br>acttgccaaatgttctgtccaactgaagctatatggttagaatag |
| Contig40_<br>gene_136<br>8 | atgcattacgcaaatactattagaaagaccagtagttgagattgagattagaaaacgtagctcaagaagtactaccaaagtactcaaatgtatg<br>ttaaacaccggttctgacatatctcaaggagcttgtaagaaaagaggttccacctaaaggaagaatataagaaacgcttccgtacctgttat<br>atgatcctcgtgacatgtctcctcacgaaggtacccattttgtattgtaaagtccatgggctaacactatcgtaagccacgaaacctatcgtgttca<br>aaatcaagagatgctcctacacaaggtattccacgctactgtagaaaaaccgacagaaaagttctactcatgcagacttaatgagatgggcatacaaaaa<br>gaccctacctacagaagatgacgacgtattgacgacgttattgaaaacatgaatcctaggtgaaagacccagtttataactga |
| Contig40_<br>gene_136<br>9 | atgacatatgagccacctgtaactgattacgattatattgtagaaaactgtacttgtgcatttgcgttgtaactgtgacgactagattc<br>ttagttaaaaacggtcacgtggttgcgtaagacacgcatgcagattaggtgcaagtaagtaatggaagatatggaccaaagtactactgtg<br>ccaatggtaagaaaacgaagaaggagttcttgaagaggttcttgaagctgcactgacactgcagctgaatacattgcaactccatcaga<br>cctgtattctacggttgctctgaaacttccacgaagtctacaaagctctacaaacctatccaaacctaggaagttaaaacagagctgacgtt<br>gcaaccatctgtcacgtccaagtctgaagcaacgctgaactctcagacactgcagttagcacatatgtctgactatgattgattttcgaacaaagagga<br>agattcgacaaaccgttatcactatgaagccttaagagcttgcagaattcgcgaatcgcagacttaagagctgctactgcacagaacatcataggcaaacatcataggcaacatcataggcaacatcatgaa<br>tacggttctacaacgttaagagctgcagaattcgcagaacttaagagctgtactcagaacacctgagagctacttaaggtaaagcaagaaacattgacatc<br>ttagctgcagaaaccttccagcaaactgaagctgtactcagaacacctgagagctacttaaggtaaagcaagaaacattgacatc<br>gcgattaaattgtacaagactgtaaacaccaacagttcgtgttctcttcgtttagtttaacttaacctaggactcactcaatgagagctcacttaacgtaaacgtttcaacatcttc<br>atggcttacgaaccggttgggcattcgttggtgtagactcggtgtaacctaggagattatatgatgggtgaaccaccaacatgacttactc<br>g |
| Contig40_<br>gene_137<br>0 | atggaatatatacttaaaaatggtattgttttacgacctgctaatgaagtaaacgagaaaaatggataatgatatctgcttcaaggatggtaaaatc<br>gttgaagacgtatccgctgacgcagaagtattagacgtcactgacgtaatgcctggtgtagacctcacgtcagga<br>ccaaaattggttgtaggtagattatacagacagaagatgaaagagagtagctcaaaaacaacaaacagcagcagcgtgttc<br>tctatccaagttgtcctaccactgtatacacttaacactatctaacattgacaattcaagacgtactgccactcttgtgaagcaaaa<br>cacacagaagaaattgacgattggcagcattcattgcagcatgatacgatcaatgttaagagtatccaaagtatctcagagagttgtaacctcagagagtttgaatatgctaga<br>gaagcgtgggatgggtatgaactaacgatactgatgaacgtccatacttttgacgtaacctccagaggagtttgtaagagcttagca<br>aagcaaacgaaaattagagctctcaaagacattgcaatcaacatatttacaaaagatcaacacccgaacgttagtcaccctgaacgttccactacaccatttacagttccactcc<br>ttagactcaaggcagaacactccaatatcaaccaagctaaccatcactcgttccgtaagagatcaaacatcaacaacatcactcgtcctgaagaatgtgctgacttcattaacaagaaccatataactagtctgacgtagt<br>caagtaaccttcgacgaaccactacaatgactgcagacgctcctatgaatacgactgtttaagattctgattaaaatgggctaacaag<br>g |

FIG. 6B-24

| | | |
|---|---|---|
| Contig40_gene_137 | 732 | atgaaaactattactttgatcaaagaaaactcttcaattgcttagaatttgatgagttaatcactgataacatttacgcttgaccgaa<br>gaggactttgcagaatacaaagttcctatagaaactccagattccaatcactactgatttcacgttgaagaagcagaatct<br>cctgctgaagtcgaccttgaaattgatttcaaacagagattgtaacagagtaaatacatcggctgtgtaaatgagcgctgtggtgaagtagtgttaacggt<br>gacgctgaccttgaaattcacgtaggtgcagaaatgctgcggaattctgtgcgtaatcgttacgtattcgtagtgcagctcacgcgcgtcgtgaaatgaaggt<br>ggaaaactcgaaattatggtgaaacaatgtggtaatgtgttagtcgtgcatcctatatcgtgaatggaatgaaacgttttagtgactgtgtgatattctgcagtattcacatg<br>cacggaaacgctaccattgaaatcgatgtaatgttaacgttgcctgcgtcagatgaaaacgtaacatagtcatccacgtaaagtagga<br>actaaagtacttgaagttctgtagaacaaggaatcgtcacagaccctgaattagatgagtcacttatcctgcagatacatcgaataaaagg<br>agattacttgaagttctgtagaacaaggaatcgtcacagaccctgaattagatgagtcacttatcctgcagatacatcgaataaaagg<br>gacattgcttaaacgtaaagtacctattaatcgatgctgagaaaaacagagacagattatctacctgattgaagagacgaatat<br>aacgcaattagagaatacagagaccaataa |
| Contig47_gene_224 | 733 | atgaaattggtatagaattcgtacctcaaataccattagatgaactcgtaagattagtaaaatagcagagacgtcgtttgaatacgca<br>tgatcactgaccatacgtaagaagtcctgcaattccgcttcgtattgcataggtattgcatggaaaaaccttagcattgacgaaaccttctaacgtgagagcaactctcgtgttggt<br>accaaccatacgtaagaagtcctgcaattccgcttcgtattgcataggtattgcatggaaaaaccttagcattgacgaaaccttctaacgtgagagcaactctcgtgttggt<br>cctgtgacaaagcaaccttgacgcataggtattgcatggagcagctttagtgagcagctgagaagatcgctgaaatcgctgaaatcgctgaacagtcca<br>ttagacggtggaaaaccgcaagctgcatgaaaatcgctgaaatcgctgaaataaagatttcgatgtgtattaattaacgctgcatacactgctacttccattggtactctgaagctgctatgcatgcatatgattaaa<br>aaggaattggcgaccagataaagatttcgatgtgtagctgcatacactgctacttccattggtactctgaagctgctatgcatgcatatgattaaa<br>aaatcgtagttgcattattgcagcaggttcaccactccagtaattggtcagtaacctgcagtaaaccatggtgaa<br>tcttagcacaagtaacttcggtggagctattgcgtgagctattgcgtgacatgggtgtaactcaatacgtagcaggatctcctgtaggtaaaaacgtagaagaatctattaaatta<br>atacctaagattgaagcattagctgacatgggtgtaactcaatacgtagcaggatctcctgtaggtaaaaacgtagaagaatctattaaatta<br>ttaggagacgtaattgctagcttctaa |
| Contig47_gene_269 | 734 | atgaaagtagcaattttaggtgctggctgtacagaactcacgcagctagtggaattacaaatttttctagagcttgtgaagtagcagacgca<br>accggtaaagacaacatttcaatgaccccactctaccattgaaatggtgcagaaacttgagaattagcagttgtagcgaagttgtagtagct<br>gaccctgtatttgacggcgaattcactgtagtagaagacttgactatgcagctcacaaagctgaaacctgaagatgta<br>atgcctgcaatcagagcaagcaaaagtaggagaattagctgaaaacgtaccctaaaccagctaacggtgctatccacttcactcaccctgaagactta<br>ggaatgaaatgtactactgcgatgtaattaaagacgtgtcaatgcaaccggtgcaatccaccggtgcagtagctgaagcagtagcaatcatcccgatgcagctgttaccagaaggggtagcaacctgctatc<br>atcgaaaaattcgctgatgtaattaaagacgtgtcaatgcaaccggtgcagtagctgaagcagtagcaatcatcccgatgcagctgttaccagaaggggtagcaacctgctatc<br>ttaggcaaaacgctaaacgtagctcattacctaccggtcttcttattactgtctctacagagacactgtaactcaatttacctgcaaaatgatgctgttaaccctgcgcatta<br>gcagctatcgacaacttaaccagtagagcatggcaaaagcaagaggttccgcattcacttacctgcaaaatgatgctgttaaccctgcgcatta<br>tgttccgcagtaactgacaccttaaccacgcattaaccaacgcattaaccaagctagttgaccacagacactgtaactcaatttacctgcaaaatgatgctgttaaccctgcgcatta<br>atgatggctaacgaagcattaaccaacgcattaaccaagctagttgaccacagacactgtaactcaatttacctgcaaaatgatgctgttaaccctgcgcatta<br>ttagtactgctgactcaatgaactctcggtccattatctgaaattgtacctactatcttagaatcttagaaaaagatcttagaaaaagatccaaatag |
| Contig47_gene_358 | 735 | atggcggataaaaacctactgcagaaactgcctgttgtaagtgcctgttggcgcagcacggatccagaaagccctgttgctgtaaccaca<br>ttgcttctcacaatgaagacattcctgcacgctgccagccattgctgaccttgcaagactgcaagaaaaccttgaattgaaaagttgtt<br>gcaaacatcattcaaaccctaacatagattttgattttgttgctgaagtgctgaagacacattacagttcaagttaagcatta<br>tatgaaaacgctgtgaccctgagaaaagaaatcactgagctactgagcaacgaacgcagagcgtggagcaatcactcaatgaagtgttgaa<br>cgattccaacaacattgtgaacttgttgatatgattgacaacgaagacgtggagcaacgaagttaaggaatgcaaaagttcataaaagat<br>cctggtgcttttgaagaggattctttagtgattaagattgataagaagaagatattctaaaaaagcagtttgtgaatcttcatctgaaagt |

FIG. 6B-25

| | | |
|---|---|---|
| | | gaaaaatagaatccgaagcataa |
| Contig49_gene_209 | 736 | atggttagtgtcaatttagaagctaaaaaaactgtagatgtaatgattgaaaaggctgacgatcttaacattgctgtttccaaattagaaaac<br>ggcgcaactgtcattgactgtggtgtaaatgtcgcaggtagttcaaagcaggtgaattatatactaaagtatgtcttggaggattagctgat<br>gtaggcatttccattcctggagacttatctgaaaaattcgcattgccttctgtaaaaataaaaacagacttccagctattccaccttaggt<br>gcacaaaaagcaggttggtccgtcagtgaggagactcttctttgcattaggtccgtccagtccagtcagagcattatcctaaaaccagctgaaacc<br>tatgaagaaattgattacaaagatgaagctgatcttgcaattctaactttagaagctgacgtattgcctgtgaagatgtagctcaatacatt<br>gcagatgaatgtggcgtagatgttgcaaacgtattcttgctgtagctcctacccgcttccttagtgtacatgcagcaggtattcaaattgcaggaagagtc<br>gttgaaaacgtacctacaaaatgttagaattcttaaagttcgatgttaaaaggttgtacatgcagaacttactattatgtcaaatcagaagaaggagat<br>gacccagacgattaaaggctatggtaaaccaacgatgcagtgctctttggcggaagatacggacaaaccattctttgacgtattaaagatgcaggatttgac<br>gacattgcagcagttgcagtcgacaaaggaaatgtttgcaccagctgaagttgttatcaacgattcaaccactggtaaattatacaaagaagtttcgttaac<br>ttctaccaaatcgacaaaggaaatgtttgcaccagctgaagttgttatcaacgattcaaccactggtaaattatacaaagaagtttcgttaac<br>gctgaattgcttaaaaaatcctttggtatagaataa |

FIG. 6C-26

ORFs encoding methanogenesis pathway enzymes identified from *M. ruminantium*: amino acid sequences

| ORF | SEQ ID No. | Amino acid sequences |
|---|---|---|
| Contig40_gene_238 | 18 | mvnydkvedtffesfdgmyiralitaedeltvkeaaydatatpsavigrveagvesfvsgdktpdgrpgaivqfwltddlakfekelsyrirq dilvkpftrvfsitenpvgsipmmesvghcgdgyeweieeygrkminvpiavpdfqieselayaegimggnfwymcstkeavlkagriiidti mevdgvctpfgicsaaskpetnfpeigpstnhpycpslrerlgkeskvpegvnyipeivinavsqeamnlaikkavdaiidggverisagnf cgqlgchktnlldilke |
| Contig40_gene_692 | 19 | mfrfdkeqlvvdiagvkmggpgeyptvlagtifygghkiisdekagdfdkdaaegliktmeemsdvtgnpcvvqtfgataeamvkylefvgd icdkpflidstaaaakiagveyvqeaglaeravynslsmaaeageieavansdidasillgfnpmtpgvpgkleiwetgsvidegilemaer cgitkpwmdvavtplggagpavrtsyavkakwgypvgsgihnvpsawdwlrqykkehkeawpvcdigsnivqqmaggdfvlfgpiensrlaf pacgmadimiaeaardigtepieahplnlll |
| Contig40_gene_693 | 20 | mseeesvpqiivstddmaaainkldeaeekvefavgeyfqrlgqqngrdigilygiilglvilivsiefglvsamstmltslv |
| Contig40_gene_694 | 21 | mvrfsnkpntrgirnasnnveyraklgregrlfagvistrfsgmaigiglalalavvipylaklcgl |
| Contig40_gene_695 | 22 | madkkpaadnwpvvsgdyivgdpespvavttlashnedipaaagaiagpcktenlgiekvvaniisnpnirflilcgaevqghitgqsiqal hengcdpekkkitgatgaipfvenipmegverfqqvelvdlidnedggaitakvkeciekdpgafeedamvievkegdddegeeirpisa etallearirnidtqvklvgavqrnmagnysgkvqgimigliftlvigflllmapllga |
| Contig40_gene_696 | 23 | mvlpliqfipelnlnldpetgllgagggdliilsmdeingeiakveaaadelmnsldpnsaplgsfpgregnfviagtltnmvygfiigmfli maampiltamgvl |
| Contig40_gene_697 | 24 | mdqviaclgavcailwgvlairsvasyglgtgvpsigymslgigvigalagvgiiaafklkglemlgpilalvfamligllvaivakkivgmk ipvmerctaeiagaaalavlgfssaiaggysidillltavvapgfialfyilvtmaiqhpfnacigpnedqvrtlkcgastafltmiitgilai saggyawfailvvgligwyvsfkmfvnasyeaaasvkwsglwpkvee |
| Contig40_gene_698 | 25 | mdlfificvviaqiimgqvhfipvggapaamatatqvtgtamlaagagltglitaasmtgpvwliviagavgsmlmmgitmlignfiyi fgvgvvpasgkaavdpitgwnqekyktpgteghgiptvcyisgiiggllgagggivywainefatanltgfdatviaglaailsvgmffins vtasyniggtiegfvdpkfkrlptgilacavvslvaaifmvlmiggi |
| Contig40_gene_699 | 26 | mdpitlgvvalmgaaatiagaaediesdigsqsnpnsqvqlapqmghlhrminkaasgepvaygcwcgisgaiaalamgmiipivaiamgst vaalvhaiytvtshmgrivggsqfeqplfmdvltgslgpiaahgfiasfgivgiaylmtlpldglghpfplpllavlwgitigaigsstgdvh ygaeseyqkfdyggtpvaiqgdivtkaplgaknsidvgnfcakyggpltgfcfglivfvsfwitvvfgalggqivgivivilliaanyllek strakfgpyee |
| Contig40_gene_700 | 27 | madkkfldamtkkfkeapeekttfynmggwtqserktefvnegkaiaeargipmynpdignplggqralmsyqlsgtdtfveggddlhfinnaa mqawddirktvivglntahnvlekrlgmevtpetitnylevvnhampgaaavqehmvetnpllvddsyvkvftgdddlaaeidpafvldink efpeeqaealkaevggaiwqivrvpsvvgrvcdggttsrwsamqigmsmisaygqcagegatgdfayaskhaevigmgtylpirraragnelg gvpfgfmadicqatrvtddpvesalevvalgaalydqiwlgsymsggvgftqyataaytdnvlddfsyfgkdyvedkygdlcsapndmdtvld vgsavtfysleqyeeypallethfggsqraavvsaasgistafatgnaqtglsawylaqylhkeqhsrlgfygyydlqdqcgaanvfairndeg lplelrgpnypnyamnvghqgeyagiaqaphsargdafavnplvkiafadknlpfdftkvraefakgalrefepagersiiipak |

FIG. 6C-27

| | | |
|---|---|---|
| Contig40_gene_701 | 28 | maqyypgtsqvaenrrkftnpdvelevlreisdedvvkllghrapgeeyksvhppldeldepddiireivepidgakagdrvryiqfvdsmyf apaqpflrarsyvyrgidtgtlsgrqiieareredveriskeileneyfdtartgirgagvhghslrldenglmfdmlrrqvlnketgnvem vkdqigreldepvvlgepldeetlraknhnlqm |
| Contig40_gene_702 | 29 | migrcthlvdcretrglgeggiagrgtfaecgsdvlavamspgrrhitkpvceitfglreanlltstmildagsgvphdapaggagnafglt dkeveqmqkfkvivvhlggvrnhitykarlilirnvnkpcviiceypvdfedfakigvktakvmpdevktegkimnivsgvirgqtvsqeklde iirkvrltlgda |
| Contig40_gene_703 | 30 | mdieifphrilgtdttekvlndlesldsvkrtviqgprlppqdeidriygdrrilvvngeevelkvktgrifvelydesgieeiraicdkhid tgfdintskaqyirkqktvtdglkygenteipeeligiadtrskfnehvsilrkdgle |
| Contig40_gene_704 | 31 | makfddkvdlyddrgslvesdvpiealsplrnpaikniisgvkrtvavnlegieksktasvggakskilgremdldivaqadsinaslkeml qvtedddtkceilsggkrilvqiptirldssaeysvatlatataltqailkefdvsmydanmvkaailgrypqsveymgsnlktmldvpqkle gpgyslrnikandfvaatlkntlqatalasifeqtamfemgdavgayermhlglayqlnadnmvlglvqdnakegtvgsivqdtiakaead gviavekeltdynmyatndaakwnayaaagctaaimvnvgaaraaqgipstilyfndniefatglpgidfgraegvavgfsffshsiyggggp glfngnhvvtrhskgftipcvaagmaldagtqlfspeatsglikevyseidefreplkyvalaaaeikgdi |
| Contig40_gene_802 | 32 | meingveiketyaegfgikvtrilvtaataklakiaateatgyatsvigcpaeagidcfvpsectpdgrpgyaimichaskkaldhelmerig mcvltaptaaafnllesedelktaflkyfgdgfekdccidgrkvhsipimsgdfivestfgfkagvaggnffilakdqitgvkaagmavaai rnipgtitpfpggmvasgskvgsnkysflpastnekmcvtlkdqvdsciredaegvfeividgldeesvkkamkagivaacsvdgvleisagn fdgklgayilnlhdlf |
| Contig40_gene_925 | 33 | mcdimvvkigivksgnigtspvldlllderadrpnidvrvfgsgakmnpegvedvvpkldqfdpdfcifispnpgapgpararellsekdlpa iiigdapgkgkkdemdegglgyiivmsdpmigakrewldptemaifnadilkvlaetgalrlvqktldaviaaadageeielpklivtaekav eaagfanpyakakaiaayemagavagldmkgcfmtkgfenfiplvaaaheiasaaaklageareieksndtvlrtphmkegnlgckvdliskp vdk |
| Contig40_gene_1365 | 34 | mpkhivsglkylesvelrkrglsqkeisseigvdrstishylngrnisadsielakvilelnpkdfiliarvlfgdyneirqlisifnmnhyd pqiddgcigcglcvdlcevksisldslkakinpryccgclmcvedcptnsikilev |
| Contig40_gene_1366 | 35 | mvkniketegknficirslgeervlsfkdhvcvgclceatcpveaisldevapierkyvdtyfsghekiaqnyalftndneikakldicedk cvlcglcsgvcpagalelaidgvsikeneayphlvtsaeidedkclfckkceaacpresitidrklpnradlvtgeievdeeeciycgacael cpaeaivvdkatgeesividkekcvyclvckacpvdaikavcrscsygeydldpakaaitgnaiidsetcikcgwcegvcpadaatvkqafk gtleideekcgtcgacidvcpcnvlsfpkstgpgdrgthlvkeedycihcgacakvcpnealtvtrtdvdytptssskswiaafealkn |
| Contig40_gene_1367 | 36 | melkvdqkclgcgvcviacpvnasispenagghgskttetimmvengfiklfsvdkcdkcgtcqmfcpteaiwle |
| Contig40_gene_1368 | 37 | mhyantylerpvvgdlenvaqegttkvlkcmlntgsdiyqgackkrgstlkeeyknasgtcymdprdmvklgvknwdtvlvktdygevvlnaa ksrdaphegtifvckgpwantivshetyccsdptykgihatvektdrkvllmadlmrwaykkyvdeeddvienmeslgerpvyn |

FIG. 6C-28

| | | |
|---|---|---|
| Contig40_gene_1369 | 38 | mteppvtdydyivenctcafcgcncddldflvknghvvavrhacrlgaskvmedmdqrllvpmvrneegvleevdwdtaldtaaeyiansir pvfygwsetstecmkegvelgyeyigavldnqatichgpslqamqnagypiqtlgevknradviaysgsnamnshprhlaryaafprgyfrqrg rfdrtvitmdpkfsdtakmsdkwigfeqngdygfynalravlkgkklqsesvsgipaediyelaaemeaaefgvlffglglthtlgkqrnidi aiklvqdlntnskwgltpmrghfnvngfnifmayetgwafgvdfcrgygrymmgetntidllvrkepdcfmviaadpganqhladip vigidihwgpsteladvvlpgsfisvecqgtsyrmdgvpiwmkkaidkpetcrddewivrelkervmklreepnvadeyvpneglaclldk |
| Contig40_gene_1370 | 39 | meyilkngivydpanevngekmdicfkdgkivedvsadaevldvtdkivmpagvdphahvagpklvvgrlyrpederrgvaqktkttraeagf sipscpttgyrysrmgygtvceaamppleakhtheeintipnidinplplfgnnwfvmeyarenriddlaafiaamlrvskgygvkivnpcgs eawgwgmnvhgyddkapyfdvtsrevvralakaneklglphsihihpndlghpgnvpttiatldsikdiakstkpsasvrdqtihcthlqfhs ytgnswkdaasgaeecadfiinknpyvtcdvgqvtfdetttmtadapmeydlfkisglkwankdiecetaagiipciysphtpvstlqwaigle lflhienpwqvclttdhpnagpfirypkiiswlmsapkrmemidngevhkwaskrtglaglereydfyeiatisraaparihgfadrgaltpg ynadiavydinpndfdpsrdpegvekafsnayytikdgqivvkdgdivstkqshtiwtnvigyeeeekqiidsimpfftqyysvkwenyqvhd hyvpnptvvdveak |
| Contig40_gene_1371 | 40 | mktitfdqkktssialefdelitdniyawteedfaeykvpignsrfpitdyfcitvegeaespaevkmilngdcnrvkyigcksmagevvng dadlhvgaemsggivtvfgnvaahagremkggkleimgntkefcgasyigewrgmsggeiiihgnagkqcgeclvggkihvlgdcdilagihm tkgtieidgnvnrwpggqmkngnivihgkvgrllegfveggivtdpeldgvtypgryieykgdialngkgtllidaeknrdrlstwieeddey naireyrdq |
| Contig47_gene_224 | 41 | mkfgiefvpqipldelvrlvkiaedvgfeyawitdhynnknvyetlaliaantetikmgpgvtnpyvvrspaisasaiatideisngratfgig pgdkatfdalgiawekpvstikaaiadittlldggkteagaalggakvqdaipiymgagpkmletageiadgvlinasnpkdyeaampmik kgigdqdkfdvaaytatsigtdseaaknaakivvafiaagspppviarhglpegfneqmgeflaqgnfggaigavtpealdafsvcgtpdef ipkiealadmgvtqyvagspvgknveesikllgdviasf |
| Contig47_gene_269 | 42 | mkvailgagcyrthaasgitnfsracevadatgkenismthstiemgaellelagvdevvadpvfdgeftvvedfdyaeviaahkagnpedv mpairakvgelaetvpkpangaihfthpedlgmkcttddreavadadwimtwlpeggmqpaiiekfadvikdgaivtsactiptpglnqifed lgknvnvasyhpgavpemkgqvyiaegfadgaaidtlkdlgakargsaftlpanmvgpvcdmcsavtaityagllsyrdtvtqilgapagfaq mmanealtnvtklmadegickmddalnpgallgtadsmnfgplseivptilesleskrsk |
| Contig47_gene_358 | 43 | madkkptaenwpvvsgdyivgdpespvavttlashnedipaaagaaiagpcktenlgiekvvaniisnpnirflilcgaevqghitgqsfkal yengcdpekkkitgatgaipfvenipmegverfqqlelvdmidnedggaitakvkeciekdpgafeedslvikideeryskkssfvessses ekiesea |
| Contig49_gene_209 | 44 | mvsvnleaktkvdmiekadlniavsklengatvidcgvnvagsfkagelytkvclggladvgisipgdlsekfalpsvkiktdfpaistlg aqkagwsvsvgdffalgsgparalslkpaetyeeidykdeadlailtleadvlpgedvaqyiadecgvdvanvfllvaptaslvgsiqiagrv vengtykmleflkfdvkkvvhaagiapiapidpdglkamgktndavlfggrtyyyvkseegddiaavaaqlpssaadgygkpffdvkdagfd fygidkgmfapaevvindlttgklykegfvnaellkksfgie |

FIG. 7A-29

**ORFs for cell surface proteins identified from *M. ruminantium*: Annotation.**

| ORF | Annotation |
|---|---|
| Contig40_gene_34 | hypothetical protein |
| Contig40_gene_35 | LemA family protein |
| Contig40_gene_39 | hypothetical protein |
| Contig40_gene_40 | hypothetical protein |
| Contig40_gene_41 | hypothetical protein |
| Contig40_gene_51 | adhesin-like protein |
| Contig40_gene_54 | hypothetical protein |
| Contig40_gene_63 | adhesin-like protein |
| Contig40_gene_70 | hypothetical protein |
| Contig40_gene_72 | hypothetical protein |
| Contig40_gene_75 | hypothetical protein |
| Contig40_gene_87 | adhesin-like protein |
| Contig40_gene_88 | adhesin-like protein |
| Contig40_gene_105 | adhesin-like protein |
| Contig40_gene_119 | molybdopterin-guanine dinucleotide biosynthesis protein A MobA |
| Contig40_gene_141 | adhesin-like protein |
| Contig40_gene_155 | adhesin-like protein |
| Contig40_gene_156 | adhesin-like protein |
| Contig40_gene_157 | adhesin-like protein |
| Contig40_gene_158 | adhesin-like protein |
| Contig40_gene_161 | hypothetical protein |
| Contig40_gene_163 | 2-dehydropantoate 2-reductase PanE |
| Contig40_gene_164 | hypothetical protein |
| Contig40_gene_165 | hypothetical protein |
| Contig40_gene_169 | hypothetical protein |
| Contig40_gene_179 | hypothetical protein |
| Contig40_gene_187 | hypothetical protein |
| Contig40_gene_203 | adhesin-like protein |
| Contig40_gene_221 | adhesin-like protein |
| Contig40_gene_228 | SNase domain-containing protein |
| Contig40_gene_231 | adhesin-like protein |
| Contig40_gene_232 | adhesin-like protein with cysteine protease domain |
| Contig40_gene_248 | hypothetical protein |
| Contig40_gene_251 | hypothetical protein |
| Contig40_gene_252 | hypothetical protein |
| Contig40_gene_260 | hypothetical protein |
| Contig40_gene_261 | adhesin-like protein |
| Contig40_gene_269 | adhesin-like protein |
| Contig40_gene_296 | hypothetical protein |
| Contig40_gene_297 | hypothetical protein |
| Contig40_gene_306 | UDP-glucose pyrophosphorylase GalU |
| Contig40_gene_310 | adhesin-like protein |
| Contig40_gene_317 | geranylgeranyl reductase family protein |
| Contig40_gene_342 | adhesin-like protein with transglutaminase domain |
| Contig40_gene_344 | adhesin-like protein with transglutaminase domain |
| Contig40_gene_346 | adhesin-like protein |
| Contig40_gene_349 | hypothetical protein |

FIG. 7A-30

| | |
|---|---|
| Contig40_gene_352 | adhesin-like protein |
| Contig40_gene_359 | adhesin-like protein |
| Contig40_gene_411 | hypothetical protein |
| Contig40_gene_431 | signal peptidase I |
| Contig40_gene_448 | peptidase S49 family |
| Contig40_gene_466 | hypothetical protein |
| Contig40_gene_483 | ABC transporter substrate-binding protein |
| Contig40_gene_501 | adhesin-like protein |
| Contig40_gene_553 | ABC transporter substrate-binding protein |
| Contig40_gene_636 | hypothetical protein |
| Contig40_gene_721 | ABC transporter substrate-binding protein |
| Contig40_gene_730 | CBS domain-containing protein |
| Contig40_gene_732 | hypothetical protein |
| Contig40_gene_733 | hypothetical protein |
| Contig40_gene_749 | hypothetical protein |
| Contig40_gene_750 | adhesin-like protein |
| Contig40_gene_762 | DGC domain-containing protein |
| Contig40_gene_766 | dihydroorotate dehydrogenase PyrD |
| Contig40_gene_769 | coenzyme A biosynthesis bifunctional protein CoaBC |
| Contig40_gene_776 | adhesin-like protein |
| Contig40_gene_787 | energy-converting hydrogenase B subunit H EhbH |
| Contig40_gene_815 | hypothetical protein |
| Contig40_gene_824 | adhesin-like protein |
| Contig40_gene_828 | cobaltochelatase CobN subunit |
| Contig40_gene_829 | adhesin-like protein |
| Contig40_gene_830 | adhesin-like protein |
| Contig40_gene_834 | adhesin-like protein |
| Contig40_gene_835 | adhesin-like protein |
| Contig40_gene_836 | adhesin-like protein |
| Contig40_gene_837 | adhesin-like protein |
| Contig40_gene_841 | adhesin-like protein |
| Contig40_gene_847 | hypothetical protein |
| Contig40_gene_848 | hypothetical protein |
| Contig40_gene_867 | hypothetical protein |
| Contig40_gene_872 | adhesin-like protein |
| Contig40_gene_900 | signal peptidase I |
| Contig40_gene_906 | hypothetical protein |
| Contig40_gene_909 | ribonuclease |
| Contig40_gene_917 | adhesin-like protein |
| Contig40_gene_930 | adhesin-like protein |
| Contig40_gene_964 | adhesin-like protein |
| Contig40_gene_975 | glycerol-3-phosphate dehydrogenase (NAD) |
| Contig40_gene_976 | adhesin-like protein |
| Contig40_gene_982 | hypothetical protein |
| Contig40_gene_996 | hypothetical protein |
| Contig40_gene_1008 | adhesin-like protein |
| Contig40_gene_1021 | adhesin-like protein with cysteine protease domain |
| Contig40_gene_1025 | adhesin-like protein |
| Contig40_gene_1026 | adhesin-like protein with cysteine protease domain |
| Contig40_gene_1029 | hypothetical protein |

FIG. 7A-31

| | |
|---|---|
| Contig40_gene_1036 | hypothetical protein |
| Contig40_gene_1037 | adhesin-like protein |
| Contig40_gene_1038 | adhesin-like protein |
| Contig40_gene_1039 | adhesin-like protein |
| Contig40_gene_1042 | adhesin-like protein |
| Contig40_gene_1044 | adhesin-like protein |
| Contig40_gene_1054 | adhesin-like protein |
| Contig40_gene_1073 | adhesin-like protein |
| Contig40_gene_1074 | adhesin-like protein |
| Contig40_gene_1084 | adhesin-like protein |
| Contig40_gene_1088 | adhesin-like protein |
| Contig40_gene_1089 | adhesin-like protein |
| Contig40_gene_1093 | adhesin-like protein |
| Contig40_gene_1096 | adhesin-like protein |
| Contig40_gene_1097 | adhesin-like protein |
| Contig40_gene_1098 | adhesin-like protein |
| Contig40_gene_1099 | adhesin-like protein |
| Contig40_gene_1100 | adhesin-like protein |
| Contig40_gene_1104 | adhesin-like protein |
| Contig40_gene_1106 | hypothetical protein |
| Contig40_gene_1158 | adhesin-like protein with cysteine protease domain |
| Contig40_gene_1176 | adhesin-like protein |
| Contig40_gene_1198 | protein disulfide-isomerase thioredoxin-related |
| Contig40_gene_1215 | molybdate ABC transporter substrate-binding protein ModA |
| Contig40_gene_1238 | adhesin-like protein with cysteine protease domain |
| Contig40_gene_1247 | hypothetical protein |
| Contig40_gene_1254 | hypothetical protein |
| Contig40_gene_1264 | adhesin-like protein |
| Contig40_gene_1270 | ABC transporter substrate-binding protein |
| Contig40_gene_1274 | adhesin-like protein |
| Contig40_gene_1296 | hypothetical protein |
| Contig40_gene_1331 | hypothetical protein |
| Contig40_gene_1350 | adhesin-like protein |
| Contig40_gene_1351 | adhesin-like protein |
| Contig40_gene_1355 | adhesin-like protein |
| Contig40_gene_1362 | adhesin-like protein |
| Contig40_gene_1363 | adhesin-like protein |
| Contig40_gene_1364 | adhesin-like protein |
| Contig40_gene_1367 | tungsten formylmethanofuran dehydrogenase subunit G FwdG |
| Contig45_gene_8 | conserved hypothetical protein |
| Contig45_gene_20 | conserved hypothetical secreted protein |
| Contig45_gene_21 | conserved hypothetical protein |
| Contig45_gene_30 | hypothetical secreted protein |
| Contig45_gene_35 | conserved hypothetical secreted protein |
| Contig45_gene_36 | peptidase C39 family |
| Contig45_gene_60 | poly-gamma-glutamate biosynthesis protein |
| Contig45_gene_64 | UDP-glucose/GDP-mannose dehydrogenase |
| Contig45_gene_89 | UDP-glucose/GDP-mannose dehydrogenase |
| Contig45_gene_91 | adhesin-like protein |
| Contig45_gene_93 | adhesin-like protein |

FIG. 7A-32

| | |
|---|---|
| Contig45_gene_100 | hypothetical protein |
| Contig45_gene_106 | hypothetical protein |
| Contig45_gene_116 | conserved hypothetical protein |
| Contig45_gene_142 | adhesin-like protein |
| Contig45_gene_159 | homoserine dehydrogenase |
| Contig47_gene_98 | adhesin-like protein |
| Contig47_gene_7 | adhesin-like protein with cysteine protease domain |
| Contig47_gene_8 | adhesin-like protein with cysteine protease domain |
| Contig47_gene_13 | hypothetical protein |
| Contig47_gene_57 | adhesin-like protein with cysteine protease domain |
| Contig47_gene_60 | hypothetical protein |
| Contig47_gene_62 | adhesin-like protein |
| Contig47_gene_4 | adhesin-like protein |
| Contig47_gene_125 | hypothetical protein |
| Contig47_gene_140 | hypothetical protein |
| Contig47_gene_146 | hypothetical protein |
| Contig47_gene_160 | hypothetical protein |
| Contig47_gene_197 | hypothetical protein |
| Contig47_gene_208 | hypothetical protein |
| Contig47_gene_253 | cobalt ABC transporter permease protein |
| Contig47_gene_269 | coenzyme F420-dependent N(5),N(10)-methenyltetrahydromethanopterin reductase Hmd |
| Contig47_gene_304 | adhesin-like protein |
| Contig47_gene_306 | hydrolase alpha/beta fold family |
| Contig47_gene_309 | hypothetical protein |
| Contig47_gene_348 | adhesin-like protein |
| Contig47_gene_349 | adhesin-like protein |
| Contig47_gene_353 | OB fold nucleic acid binding domain-containing protein |
| Contig47_gene_356 | short-chain dehydrogenase/reductase family protein |
| Contig47_gene_375 | hypothetical protein |
| Contig47_gene_380 | adhesin-like protein |
| Contig47_gene_381 | adhesin-like protein |
| Contig47_gene_382 | adhesin-like protein |
| Contig47_gene_383 | adhesin-like protein |
| Contig47_gene_391 | hypothetical protein |
| Contig49_gene_3 | hypothetical protein |
| Contig49_gene_4 | conserved hypothetical protein |
| Contig49_gene_12 | adhesin-like protein |
| Contig49_gene_25 | adhesin-like protein with transglutaminase domain |
| Contig49_gene_29 | adhesin-like protein with transglutaminase domain |
| Contig49_gene_40 | adhesin-like protein with cysteine protease domain |
| Contig49_gene_43 | adhesin-like protein with cysteine protease domain |
| Contig49_gene_44 | adhesin-like protein with cysteine protease domain |
| Contig49_gene_81 | adhesin-like protein |
| Contig49_gene_96 | adhesin-like protein |
| Contig49_gene_128 | hypothetical protein |
| Contig49_gene_152 | ABC transporter substrate-binding protein |
| Contig49_gene_167 | adhesin-like protein |
| Contig49_gene_168 | adhesin-like protein |
| Contig49_gene_172 | conserved hypothetical protein |
| Contig49_gene_175 | adhesin-like protein |

FIG. 7A-33

| Contig49_gene_180 | hypothetical protein |
|---|---|
| Contig49_gene_181 | adhesin-like protein |
| Contig49_gene_182 | adhesin-like protein |
| Contig49_gene_183 | adhesin-like protein |
| Contig49_gene_184 | adhesin-like protein |
| Contig49_gene_194 | hypothetical secreted protein |
| Contig49_gene_208 | ABC transporter substrate-binding protein |
| Contig49_gene_226 | conserved hypothetical secreted protein |
| Contig49_gene_239 | adhesin-like protein |
| Contig49_gene_240 | adhesin-like protein |
| Contig49_gene_246 | conserved hypothetical |
| Contig49_gene_248 | adhesin-like protein |
| Contig55_gene_2 | hypothetical protein |
| Contig55_gene_3 | hypothetical protein |
| Contig55_gene_7 | adhesin-like protein |
| Contig55_gene_13 | hypothetical secreted protein |
| Contig55_gene_23 | conserved hypothetical secreted protein |
| Contig55_gene_40 | hypothetical secreted protein |
| Contig55_gene_45 | conserved hypothetical protein |

FIG. 7B-34

**ORFs for cell surface proteins identified from *M. ruminantium*: Nucleotide sequences.**

| ORF | SEQ ID No. | Nucleotide sequence |
|---|---|---|
| Contig40_gene_34 | 737 | atggtccttgccttaagcataatcctactcagttcaattgcagcagcatctgcagaggattattctttaaccaatgccaaaatagatatggtaat ccaggatgacggattagtctttgtggatgaggcaatcacctaccatttttataagaccatgaatggcgtctataggtacattccaatcaataact ttaacatggaagattttgctgtagacgttgatggcgcatattatgaactggagggtaatgatgacgactctcaaatagaggctaaggtctatctc tataaggataaggataaaaccgaaaagatcgaccctggtacagatgttacagtccattataagtactacatgagcgatctccttgatgtaaaggg agacaatgcagtattgaactattatctattgggagaagattgggaggttgacttagaggagattgaagcaaacgtccatttccctgaaaagaagg agcttgattacgagcttgttccaagcggcagtgctgaaggcaagtggtctggagacacattgaccattactggagagaatattaatgctggagat ggtcttgcattaatcgttgaaatcccattagatgagttcgcttcaggcttttcaaatgctgtccacaatgacactgatgatgatgatgacataga taatgatatcgataatgataaggatgatttaaaggacttgacaaaggctaagcagatttaa |
| Contig40_gene_35 | 738 | atgagtacttttattttagtcataataatacttggtattattttaataatcgcaggaataatcgtagctctctataatggccttgtgactgcaag aaacaaggtaaagaatgcatgggctcaaattgatgtccaattaaacagaagagcagatttaattcctaacttagtagaaactgtaaaaggctatg ccggtcatgaaaaatctgtatttgaagatgtcactgctgcaagggcaggattgatgaatgcaaacggagttaaggaaatcggtgaagctaacaac caattaacaaacaccttaaagaccttatttgcagttgctgaaaactatcctgagcttaaagccaatgaaaacttcaaggaattgcaagctcaatt agctgaaagcgaagacaagattgcatattcaagacagttctataatgacactgtattgatgtacaataacaaatgccaaaccttcccaagcaatt tgattgcaggcctcttcggattcaaggaagctgacttctttgaagctgcaggtgaagctagatctgtacctaaagtcgaattctaa |
| Contig40_gene_39 | 739 | atggataataaaaaaatatttgttattgtagctttggctcttttagctatcgttgcagtaggatctgttagcgctcttgatttaggtttccttgg aggaaatgacgatcaagacactgctgctgaagatagcgatgccaagacaactactattaaaggaattgaatttaacattccagacggatatgtta aagcagaaaattacaccttagatggtgaaacaagatcaagcggaagtatagactataaggtatatcaagaaggttatgaaaaaggcgctaccgat gcaatccttttcttaattggagattatccaactgacttaactgacgatatgcttgaacaaatgaatttaggtgaaccaaagaccattaacggtca tgacggttacataaccacttccaacgaaggcggagacacattcactgtattcttctatgcagaagatggtgacttagtcactgttactgtaacag acgacacccttcttgaagaaattattaaatag |
| Contig40_gene_40 | 740 | atgaacaataaaaaaatatttgccattgcagctttagccattatagctatcgtagcagtaggatcagtcagtgcttttgatttaaatttctttgg aggagatgacaagcaaaccactactcttggaggaattgaattcaatatcccagagggatatgaaatagtagataactacactatagtaaatgaaa ctctacatgatggtgatgatgaatacattgtaaacagccagtattatgaaaacgatgatggggattcactagagctctatacttcagattatcag gatgatatggaagactatattttaaaaatactgactaaaggggatgaaaaaaccattaacggtcgaaaaggttatataaattctgaagacggatt tacaatgttcagttttgtggatgatggtaatttaggttttgttactgtttcagatgaaagcatacttgaggaggtagttaaataa |
| Contig40_gene_41 | 741 | atgaatgctaaaaaactaactattctagcagccttagctattctcgctatcgttgcagtaggctcagtaagtgcttttgacttaaatttccttgg aggagacgacagctcaaccactactgtaggaggaattgaattcaatatcccagagggatatgagataaatgatacatacactatagaaaatcaaa ctagaaccagcagcggaggcaatgaatacattgtaaatcaggaaggctatggaaactccgacggtgaggaactattgttcttagttggacattat gatactgatatcaccaatgaaatgctttccgcaatgaaagttggtgatgaaaaaaccattaacggccaagaaggttttataacttccgatgatgt atacactgtattctcttttgctaaagatggtgaattggttacagtaaccgtttcagatgaaagtgcccttgaaagcataatcaaatag |

FIG. 7B-35

| | | |
|---|---|---|
| Contig40_gene_51 | 742 | atgatttgctgtgttttattaacatttcaactgttagtgcaattgatatgatgaaatctaactgctcagttaatcattagatgctcca<br>ttcagatcagtctgcattattcacagtctgaatcttgaattagattcttgaaacaaattaaatgcaaataattaagagttctagtgagattgatt<br>gtgtagaaactatgattgagtctaattagatcctaattagatctactgttctaaatgataaaacatcttaaaatctgatcta<br>aattctattgattcagatgagtatttcttagattcaagaataaaaatcttcttaagttctattaattctagtctattcatgagatggagaataataa<br>tgagaacttggagattcttagatgccaagagggtcaacaactggcacgattcgtatatctttgatgaaagacaacttatgcgaagacaagtacatttggcgatttgcaaa<br>ccatgataaacaatggcctgtcctgctacaacagtaccaactcaagtacttctcacttcatcaacaatgcaattcatttatccacaatcaacacctcatataa<br>gaactgttatttctcatacagtacccaactcaagtacttctcacttcatcaacaatgaagcaagcgaacatgttacgtctgcattgcgagatagggcttc<br>acctgtgggttgctgtaaacatcaagtactctcacttcatcaacaatgaagcaagcgaacatgttacgtctgcattgcgagatagggcttc<br>gcagacaatgccactgtgaaaactgcaattcatcaacaatgaagcaagcgaacatgttacgtctgcattgcgagatagggcttc<br>atcctcaggcataaatgaaggatactgtgtaaattgcaccttcataaacataggttatcaccaccatagct |
| Contig40_gene_54 | 743 | atgattattgccataatcttcatgtataatctttgcccctaaaataagtgatccctagcaggattcttcggattcagcagagactgatctattgattatgcaggatttg<br>cttattctttgcttcgccctaaaataagtgatccctagcaggattcttcggattcagcagagactgatctattgattatgcaggatttg<br>cagtaatcgcatatgctgatttgattgatttatattaaaatcgacaatcaagacaatctaatgactgattgattgttaggaaattgctataagaaat<br>gaaatacaattgatgaagaaaatgatgaatag |
| Contig40_gene_63 | 744 | atgaataaggttcaattgtcctccatagttccttagtattaatattattctgtcttggctgtagtgcaaatgatgatattttaaatat<br>taatgtcactgacaccaagatagtgtaattgataattcaaatgcatatgcatatggtaaatggcacatgacaatgacatcattaatgatgggt<br>taagctctgatgatgaaactgcagttcactgagttctcaactcttaaacgactcagagatttggattcatcagatgattagcaacagttcatcagacatattggaa<br>gattctaaagagacatctaaaatcaggataattcacaaagaataagattctaaactagattcaagatgcatattcagacatagcaatctcattggaatgtct<br>ctgaaagatattcaagatctttccaatttaaggatttgaaacagaaatgagaaagtcggtcacacagatggacatctcttcatcgcgcttataaatcgcg<br>agctccgtacaagtcttttccaatttaaggatttgaaacagaaatgagaaagtcggtcacacagatggacatctcttcatcgcgcttataaatcgcg<br>agtcatgtatagtcaattcaatctgacaataaacacagccaatgacaaccaggtgtatgcaaatcttcttctattggaaactacacatagaacatacaaccaat<br>gcacaatcatcacagccaggcaacggtgattttctatccaaggaggatctgaaaagtccctgataattataagcaacaacattttcac<br>atgatctactattgtatgtacatatgatttcctactgcatatgatttcggtctgtcgtctcatgcagagcgggaggatcaggtacgg<br>tagtcgaacggtacatatgatttcctactgcatatgatttcggtctgtcgtctcatgcagagcgggaggatcaggtacgg |
| Contig40_gene_70 | 745 | atgagaaaagaaataattctatattggtaattgctattatgacaatctcagttatccacctgcctttcagcaactgacaatggtattgtaat<br>aacttacggcgaaactacatacacaaattcaaatctagtctattgtgataatctatttgcaacgcaaggatgaagttccaacgttcaag<br>gtgaagtgattactgcagctgacctgacgtaaatgcaatatcctgaataagcgaaaacatacatcactcctcaatcagatagtgcatgcgctttgtg<br>gatatgaccccaaaacaatgagatctctatgtaagcactctgtaactgcatttgaacactcctggaatctgccctgcaggaatctgcctgtatttatgagagttacag<br>aattacaagcggacatgtctatgtaagcactctgtaactgcatttgaacactcctggaatctgccctgcaggaatctgcctgtatttatgagagttacag<br>atgttgaaattccagaaaatgtaaagcaagcagctaaattacatacatacagaaaattacatatatgactatataatataatgactacag<br>gaattatcaaattggtgatgatggtaaagagaggttcaggaagaagaagttcaggaaagaggttcaagatatacaatgatgaaaacagct<br>cacaactataatatcaacattccgatagcgacattgaaaacctgcagataccattcaacagctcaagaggttcaagatgatgcaaaacagct<br>ataaggaacaattgatgctgttaacaataccacataggattctctccattgatgtattctcaatgctatattaagtatttttaatttcagt<br>taa |
| Contig40_gene_72 | 746 | atgaataaaaaagatttaaattaattattaactattttatagcatttgcactcattaacacttgttttattaaatgataatctcagcagc<br>agacaatgctccaaaggatatagcaactactatattcgtgggtctgcttcaatgtccctgactcatataaactggtgatgagggatggatg |

FIG. 7B-36

| | | |
|---|---|---|
| Contig40_gene_75 | 747 | atgtaaataggctaagctacgctcatttaaaaggaacaattcctaatatcagcttgataagcattccacaaagtttaacaagaaccttttggatgattcagttccttacaataaatgaatcaatctgaataagaaaaccatatctcatgtaactgattctatgcaagaagaatggcgtaaaagcattttgtctttgcaacagagatga |
| Contig40_gene_87 | 748 | atgatggtcattctactaataacactccttctgttcctatcctctcactaacaattgattattcaagtgatgtcataactctataagcacaagaatgaactgtcaaaataactgattcttctcgctactatagcgaaaaggttctaaaaaggtggtcttgcttgatttcaatcaagatttttctgattttaccaacaatgccaaaggggattgcatatgctgattgtcagataataaccacaaaagatatctagcgaatatgattatataggtctaaatacaaatattcagttttcaaagggtttcaataagatttttagttgaatggatgaggataccggactaatcaggctctctaagttaaattaattgatatctcttatcaagcgtttcagctataaatacaaatgattcatctctattcaagataatggagattatcattcaagactcaattgatgaaattcccaatttgatgaatcagaacaattaaataacaattcaccagaatccaatttaatcaagaatatctaatgattctaaagacatatctgcagattccaatcaagactcaatggattcgagaatttgagaattcttcaaatacaaaagagctcttattcaaatccaaggaactcaaatgtcataaatgttacaggaagcaatttcaagatgtataggaggaagcaaatgatgggacatcctttatctcaagtcatacaaattccatgggaaccgcccatcagcatcaatatagatcaagcatcatagtgagtagctacttttcacttgtcacattcactggggaaatattgacaataatgcaatggagggccatatatttgatggaacaaactgcgcaattgtaaatgctcctttaaggggaatcatgctgctggggggagccattttccaatcaaacaattccaattgatgacctttatgtggtgctgcaaatttgtagagaacaatgcccaaatgacagacatttgacggctaccacatgggatgacttcttccgcttgaaaattccacttgccaaaaattctgggcgcaatctaaaccattttaaaacgtcttcctatgctcaaatcctgcaatcaccacaatgcgtctaatgcaagtttcctatgcctcaaaattcatattgcaagctcaagttttaatacagagttaaaacagcgaaatcttcaaatcaagtagaaatgcagaattcacaatctaaaaaagaacaagctctcaagagaatataaaggatctcaatttaaaagcaacagaatcaatagatgacacatagtgtctttgcagcctctgttcatgtggaaatgccattatatgagagctgagacaactatatcttaagcgaaaatatgtttaaggagataattatatgcctgagaacaaatttatattaataagtccctaccataatgccgattctctcaattgggcaaatataatgtttacaataagcaatatccaatttacaattaccaatgctacgtagtgggatattgaaggaggtgcaatttactggtgcaattacttactactcgcaatttatgcgccaattccatatgatgcggagcattataacctgttcgcaaaataccacaactactaactacccaaaatgtacttttgacagtaatttttggtatttcgaataatgctggtcatgatggccaatggtgcagctcagttgtagtgcaaatatctgtaattctcacttcttaaaataatgtctccagaaggatggggtgtgcagtatatctataaacatgggtatgaacttattcttccttaaaaataattctgcagatgaatattaattaaaaaaaatcacatttctatgttggttttagtctatcggttttgatctcattaattcaatcagcgctaatgatttaggcactgtattggaggataataacgattaaatgtaatgatgattttataaattcagatgtgaattcagatagtataaataaagaagcaatttctaattttaaagttaaatgtcaagtcagatgaatctacatcttctgatctctaattctgtaattctaatagttccgttgctttcagttctaataagtctcaagttctaattctaatagttctgcaagttctaatctctaatagttctaagttctaattctaataagttctgcaagttctaatctctaatagttctaatctcaagacctctaattctactagtcaagacgcatctaaaactcaaactataaaattatcctcaagagaagaagtgccttaatgagttcttaaatgcaatcaaaacaactactaaaggcacaattgttctaaaaacgatttggtcctaaactatctcactctaaaacatctaataacatattacaatattacaaactatcaaaaactcataagctcctagatgttacaaacatgtttaagacctttgcaaagatcacacttaaaaaacattgtctttacaaactatcatgaaatagaaatt |

FIG. 7B-37

| | | |
|---|---|---|
| | | taaggcaatactta acttctg gagaattgactgtcctcaattcaatgatttcatatcttacaaacggctcagctatctataacagc<br>aaaaagcttaccgttcaaggactaagttctaaaccataagataaaatgatgctgtaattgtttaaataatgcagaaaggattcaattt atagaa<br>ttcctcattcaacaaaaatcatgcaggcaaaaatgtggagccatctattccacttttaaacctaatcctaaacc |
| Contig40_<br>gene_119 | 751 | atgaataatcaaatagtattcttgcatagtttagctgatgaggcatgagagcagaagaatggtcaggataaggatctatgattattacaataa<br>acctatgatttta cacatcatatgcagacaatgaatcttgaaaggctaaaccataagataaaatgatgctgtaattgtttaaataatgcagaaaggattcaatttatagaa<br>atcttctaaatcaatatgcagacaatatgcagaatatttgatttatgaattgagctctcattagtgagctcaagcccctatt<br>tcagggtcatgactgattaaagaataacagattatgcactagtctctttgcctgactctccattataagtggagatatagaaag<br>catgtttggatctcttgatgaaaatcctttcagcagtgccataatccctttcatattaagtcaataagaagttcaggacaatgaggagt<br>ttaacttaaaatctgtagatgatgacgcttgtatgtgaaatcagacagaagaattcagagcctttgcattcaattataaaaggacaatccaataat<br>ataaaatctctttagatgacttttaaaatctctaaatctaaataaacaagaggatattgataattttaaagttta aagtttaaaaaatag<br>atttgatgatgacttttaaaatctcaaataaacaagaggatattgataattttaaagtttaaaaatag |
| Contig40_<br>gene_141 | 752 | atgggtttttttcgataagttcacttcagaaatctcatgataagagaatctcaaaagaatgaagcgatttcagataa<br>tccaagagagattctcttcagataataaaatagaattctcttcagataatcaaaatagaaattcttcagtattcgataaatgttcgaaatt<br>tcaaatatctggatgatctaatccatagcgccaaaagatatgttctcgatattgtcatttgcatattgtcatttgaatcttacaaa<br>agagaatagatatcggcggagtaatatatccttgatggaatgacatgtgtgatgacttgagctcaatcagatgtgtttcaaaggcagtgcattat<br>taaaacctgcagcttttttaaaaattccattaaaaatccttgaaaatgaaatagtgacttgcaatcaatctggtttgtataggaagcataacggaat<br>ccaattgcagcttttccacattgccatataagaacaactcttccagggacaagaggagaacaattaaaatactgaacccttaatatatccgattcaat<br>ctgaccattcaccatggccatataagaacaactcttccagggacaagaggagcacatcttaatgaaggtttgctcaagctcagactcagtttaaaaatacttcca<br>tttgaatataatctctcttagatgacggggagcaatcttttaaggatcattcagatttgaaaatagcattcagatttaaaatagcaacttttaatcagctaat<br>ataacgggaggtgcaatccacagattcaatctgtttaaaggaggtataatcgaatttgctccattaataacgaaattgataaatggacatatttatttaataagtacttaccttccaatccagctactaga<br>gacatttcaaacagattcaatctgtttaaaggaggtataatcgaatttgctccattaataatcgaaattatcgagaaaagtttacttttcc<br>ctttgatattgataataaggaggtataatcgaatttgctccattaataatcgaaattatcgagaaaagtttacttttcc |
| Contig40_<br>gene_155 | 753 | gtgaagttgaagggataaatgaatttcaaggaattcaaggaattcaaggagttctctaaatgaagatataagttt<br>ggaggataagacaagcgcctattgaaatcaagacagatgcttggtcattggtcattgatgaaataacaagcttccaa<br>tattatataaaagcctctaatatcacttcaaaaacatcatctacttaaaaacgattctcagaggactatagcggtgccataactaactattcc<br>aatgactaaaggtagagcactgcatatcatagagaaaatgatttgattggaggagccatttgaggactttgaggggcatctacaagtgagaaaactc<br>taaattgactgtgaaaagtccaatatcctgaattcggaatcgatgaagagccatttacaataaggagaattgatcagaattgatacaaatccattcaatcagaac<br>attctgtatttgagctcaacatctctgaattcgaatcgatgaagagccatttacaataaggagaattgatcagatccattaaaaacaataaagcaagcagtgaaagcat<br>atggcctttaaggagaaatgaggatatttccatataaaacctcttctttgtagttttataatatatgataactattga<br>acagacagaaatgaggatatttccatataaaacctcttctttgtagttttataatatatgataactattga |
| Contig40_<br>gene_156 | 754 | atgaatttacggaatttgaagatttattgggcgcgaaggagatctctttatgagtgtcatttagaaagtgatgaagattacag<br>aagggcattgaactcaagagagagatgcttagtcattgacggcaagtgcatgtcattgatgcaatgaaaggcaaaggcattccatttcaag<br>gagataataactataaagaaactaagttaaaaatccgttctcataaggcaatgtgaatgtggaagaattat<br>tccataaaaattctcatttttcaataattgttcactgtcggcggtccaaaatgcttgatgtcatttgaagatgtaatgatgaatgatg<br>catattgaataaacttaattatgcagatgcgcggtttaaggattttgctctaatgcctaatgcctaatgcctaaaatattaatgaaaatt<br>gcagctttaaaataattatgcagatgcgcggtttaaggattttgctctaatgcgtgcaatatttaataaaacgctaatttatttatttt |

FIG. 7B-38

| | | |
|---|---|---|
| | 755 | gattgcaatttgaagataatgggtggtgagcgcttatgattgattcaagcagtgaatcgattcaaaataaaaatgcattataaccatgacaattg ctgctttaataccagagagtccattccatatccttgattttgttaatcaatagttccagattttatcatcatccgaaaatccttgaa ttcaaggtcgatttcaatcgaggcttgtaggattattatatgggaaagaaaccaatataaagtgaattagatagtgaaggtactgatagc tcagatattggtgattaatcaatgagtataagaagacatacaatctcgatacaaagaagttggcttcatctttaaaagaatatattgaatc cattaatgattcaagttcggataacttaatttagaggattcaattaggcgatattaatttatctgactata |
| Contig40_gene_157 | | |
| | 756 | atgttatattatcgtggagcaggatggccgattggattggatttggataatttggaagcagaatcatatattgacgattttccatttaatatctt gaagctctctaagctatttgaaacagtgatgaacagttcgtcgaattcaatgcagaaggatgtttttatacttcaagttctcttccgatg tcagagttggtgagagtgatatatgaagactattgatttgcaaatgatttttatctgtgaaattgaggaagaatgggcttatggcttt tttccatccgaagaacaagtgatgaagactattatgaattggtggattaatcgtcaaaatcaggacagaacattagatagaatctaataa taaatgattgatataattcacaatcttaa |
| Contig40_gene_158 | | |
| | 757 | atggggattatatgaatacggattatcttaaggaattgaagagttgaatcacactacagaaagcctatttgatttggaatctctggcttt aatcatttaaaggacggaacaaatctgaccagctggagtgagctaagcaatcctgatgatatcttatatctaagtgcagactccggtgtaagg aaaattacactgaattagtaatttaaaaatgcaaaggtgcttatcctacagaattatgtccgcccaattttggagtgggcagcttgttttc aaagagycagalclaallactaaaclglclaallLcLacllggcallcallggLcLcLaLgaalaaaclyggacalclccagcaclgallcLLLaaa gaatatgtttgccaattgcctttcattgaatatgcatatttgaggattgggacacttcccatattcgtaacttttgggaatgtttgttgcct gctgcagcttaaaggccatagatgaatggaatggagaatcttggactttgagctctgcagagaaatatgaatccatgtttgagtcctgcatgtcttgaa gacatttcattcctatctgactgggacatgtccaatgtgaaaaatgcttgaaatgtttaggattgctataggctaaaggatgcaagctgctt gaattgaaatttaagaatctaaaaaatggtgacaatctatttgcaactgaaagcttcaagctggtatgatgagttca tcaatcaattcgcatcagaaatcagctaaactaattgatgacgatttcattttctaaagattgcagggattcgaccccagacattttc atagcagtaggatatatcaggagtgaagaatgctgaaaagatgctagagaattcctccttttatgcaagaaggcgctcttttaaa tccaaacttaaatgacacagagattttagagagaattgcagatagcacaagattatgtgaaagggcctatgcaa |
| Contig40_gene_161 | | |
| | 758 | atggaagatagaagcaaaatttatcgtttatgtcgttgtatgtcttacttgcttctctgcagcagcacagtctctctatgactgcggtct ttctgattggattgtatcaaatgtaaacactcctaaatgaggatgccaatacaatggctaatagagcagcgaaggacaatattattctgactctg acggacaatattattccagtccgactcctgatgaagaacaattcaaaatgaggctgatttttagatggctctcttttcaagttcgacaattcagaa tcaaactactattcaagctctgatgaaggcctgatttttcttgcaaggctcataagtggctcataggtggcagttcaacaacagacagttatta tgactcctctgattcaaactctagggacactatgaggacacatcaatgtgaaatggattctcatatgatttaaatgaactcttacaa aacagacaataagcttaatcagttgtttaattaa |
| Contig40_gene_163 | | |
| | | atgaacatactaatcaatggaactggagctatcggaataggcttggagcatctatgatttcacaaggtgcaaatgtatcttccttgcaaggga agagactgcaaatgcaataaggcaataagcaggcatattcaatcactattcatttggtccagaatcattttaaaggtctacacag attacaaggatattccagatatgagtttgacttttgcctttgtcaagcaaaacatagctaatgacgatataagcagaaaggcaaccaacac aagtccatcttaaaagagaggatgctaaaatatcatatttcaaaacgcttttgcaaatgacgaacatacttaagattcttccaaaggaacaggt ctactgtgcaagagtcattacagggttcattgaacgccagaaagtttaaacgcccaagaagatacaLcagcgaagtcactgtccatacagaacatcagcgaagtccatagaccttaagaccctatattgcttgttctcttc aaaaggatgatgacggcgagttccattgcaaaatgtcttacgacatgcttataactgtcctaatactctcttggtgccatattgcaaggcataacttgaatatggaataccaatgoaaaactgatgga gaactgatagttcctatgcttaaaatgatgagcttattgatgaaatacacgttcttgaaggtaatcacggcatcaaggcatcaggatacaagaaccaattggacagcccag aatgaatattccgtaaaattgcttctattcaagttcattgaaagttcattgaactttgttgaacttggagaaatatggtgttgatgtaaagtgaatacagaataatggtgttgatgtaaatgtgaaatacagaagaaatatggtgttgatgtaaagtgaatacagaagaaatatggtgttgatgtaaagtgaatacagaagaaatatggtgtt aggagtataggaggagttcttctatttcaaagtcttcattgaaaagtccaggacttgttcgaactttgcagagagatgtttgatgtaagtgttgatgtgaactgtttgatgtaagtgttgatgtgaactgtttgatgtaagtgttgatgtgaac aatagagtctgaatttaa |

FIG. 7B-39

| | | |
|---|---|---|
| Contig40_gene_164 | 1375 | atgataatagtcactacaatctgtgttatcttaatttgatagtcttttttatgattgttccctggattgacaaacagcaatgataacagtga caataatctaattattcaaaatcagacttctcatttaccatagatattgaaaacgcacttatttaagcagagaaggcaaatctaaaatggtgg attccaattattccacattagaatcctatgagaatttacgattcaggctatgaggcctatgagatagaacttgacaatggctctgtatata gtcagtctgtatggttgattataatactccatctagcgatggtatataatagtgatgtagatgaggatgaaacgcttatatctcttcaa tagcaaggagagtattatgctacttaacattcaagctctagcgatcctccactttgagaattaagcttttaactagcatttcc attataatcattaa |
| Contig40_gene_165 | 759 | atgtctgatgttggtaaactgtaataacaactattattactttagtaactactggtcatttggttagtcgcattgttagcatgaacgatgcaat tcaaaattaatcgactctgtaatggtcctgagacgcactactgattattactgtttattgaccattctgcagttgttgtaa ccattacacttgctagaatagcagctaaatgggcgtaaattagaagaataa |
| Contig40_gene_169 | 760 | ttgaaatcagataaacgggctaaattgccatattctctcaattcctgccttggactgagcaatattgcagctgtatgactgaga cttgataagcggttcacttccgtaatcaatcagataagttgattgcctggacaatgacaattctctccagcaagtttgaatacagttt atgaagaaaaaagttgtgagaagtagttaatgacaatatctgatgcaaagatacgattccactccgaacatcagattccaatacggaaagt gatgatacatcaaattcaaaagttgtagaaacaataataaccataatcaacagcaatggcaacgcaattcaaaataaatgccgagcctag cctcgaggatctgcagttcagtcagacagaaacagaggaatag |
| Contig40_gene_179 | 761 | atgattaatgaataatggacaagcagaaggttataactgcctttgcataatctctatttctgcagctgctttcagtcgttgtagtcttgcc tatcttaggagttaa |
| Contig40_gene_187 | 762 | atgttaattaagagattggtttttagccataagcttattagctgttatctttgcatctatgtgcatagtttcagcagtgactctggagagggaag cttaaggaattggctaaattagtgtccggcgataa |
| Contig40_gene_203 | 763 | atgaaaacaaatcttaaaaaacaacaatcatattggcactgctgtgatggccatttttaatttatcgattggagccatctctctgcaaatgatttaac atcagcagattcaaatgtagatatgattaaacacaaatttggataacaaatttggataacaatgatataatcgccaattcaattcaattgatg ctgaaattgatgaagcaaactattcaagcaaactattcaagcccttcaaaatagagcagtgccaagcagaaacagcagttaaatagaaacaagcaattcattaataacaaacagcagacctacacaagaacaacag ggcaataccaaatagaacagaatgaaaattcaagcccttcaaaatgaaactggaactgaatcaaatgaacaaatgaaaaagcaaataccatcaataatcaatcaattgaaacaacagcagacctacacaagaacaacag tttaacaatctctctaaaggacatataatctctgcatctgaaaacaaagtctctatacaataatcctacaatggcagcgaagattatgaatcatca tcagatgacttcacatagcgttcccttcaagcgttcccctatgaacatacaaaaagatctcctatccaaaattcctatccaaaacatcaatacttcagtgcatcaatacttcagtgcagatgcaaatctcagaagagatgcaaactctaaagctctgcg ttagcttaaacattaataattaaaaagactctgaatcctgaaattcctatccaaaatcatcaataacttcagtgcagatgcaaatactctatgctatttaagatagcgaagg attgatgtatataaatataaaagcagcttacagttcaagatcagtcatgtcttactggactctcgtatgatgcatttgaaaacactcaagtctatgacga caagcaatccatccgcaaaggttgccttcaagatcaatgagtcacaagatcaataaagctgagtacagagaaacagacaagaacg |
| Contig40_gene_221 | 764 | ttgtctattgtggtgcaaacgatttgaattcaattgcgattccattgaagcagataattctaattctattgaaattgaagacattcaagttga tcctgtagaatcagatgatttagaaaagtctaatattgatgaaaaagtctaatattgatgtgggaatcagatgcgattccgcaatgaaactgaaa ctcttcatcaggtgatgaaaatatgatctgtcttctctcaatcaaatgaaggtgtagctacttaattgaattgataacgatgcgat aggaaaatgtcaagcttcaagtgcgagttggtgtcgagccatactgtcctatgatgctgaaaacactcaagtctatgacga attgcctgaagcttacaagttgcagcagtatgtcagccatcgtcacaaaggacgtactacgtacaaggcagttactacgagtgatgatgtcagccagatgctaaatgggactgaaagtcg gtgagaagagttattaaaatcgttacgaggaagaaaatgatgtgaagatgatgtgaagatgattacaagatacaatcactttgaaaaagtctacatttaacaagcgataaagcgatatattacgatcg ccggatgaatgtttacgaggaagaaaaatgatgtgaagatgattacaagatactacttaaaggtatacattaaaggtatacattaacaagcgataaaagcgatatattacgtat aggaaatccgatatttttactttctgtcttgtcttactttagccagtttagttcaatcagtcttattgacagtttaggtttaatactagaaaatag |

FIG. 7B-40

| | |
|---|---|
| Contig40_gene_228 | 765 | atgaattccaaggqaaaatatctgttttatttcttatttattcattagcataatctctgcttcatttgcttatactgaactgatt<br>ttctcatgacattccattttgcagatgggacaccatcgatgttgaaggtgttggagagttcgtttgtaggtgtcaatactccagaacgtggcgtc<br>gaatatgtacttatgtgcagatgggacaccatcgatgttgaaggtgttggagagttcgtttgtaggtgtcaatactccagaacgtggcgtc<br>acagcatatatctgctccaagcgttttgttcaaaagtctgtctgaataagaagtcagcctgatgtgatgactcaagagaaacgatagata<br>tggaagaacattggcggtggtcattgtagatgcaagaacctgaatgaaatgcttaaagaaggcctgctgagatcatgtacattcctccaa<br>gtgagttctatccatatgactggtctctacagtcctcgtcctttatgttgaagtgcaaacagtcataagttccattattccacttgcaaatgggaaa<br>tcaagcagttttacaagcggttctactaagaataagggtgacttcaatagcaggtctgatgcgataagtcaggttatgctcctgtaaggcatgtcaaacttga<br>gaagatctgataagaatagggtgacttcaatagcaggtctgatgcgataagtcaggttatgctcctgtaaggcatgtcaaacttga |
| Contig40_gene_231 | 766 | atgaagaaaaattaagcttaaaaaatatttaagcttttatcttttgtattaagcataggatcttcatttgcaacagaagattt<br>aaatacaacaggagataacaatctaatagatgataccgatgcagacacattatctgatgaaaagagataagctatcaaaagccattaatgt<br>ctgatgaaaactctaatcaataatggatccgatgagaaggttataagttccaataatagtaaatcagagagttttcttatcatacgtcct<br>aacgaatcttcttattacagtattagagggtaatttcaagattgcaagatgcaattgattatgctcagataattatacaatatatctaattag<br>taatatgttggtgaaggaaaaccgattattgttaaaaatttagaactattcatgctatcaaagagcttatgattcttataagttaagccatat<br>ttctgcatttgtctgataatgtcctgaaatagtagtattaaaaaatttagaactattcatgctatcaaagagcttatgattcttataagttaagccatat<br>gatagtaaaactttgctaaatgccctgcttaactaactaagtagttcttgatgtatagtgtccctcctcttaattcaactgatgatattgaatatgg<br>ttgggtcctgctattaaatgccctgcttgaaacaatggacattgattgactctgcaattttaaataagatagattgcaattgatlatgctaatgatatttgggg<br>aagtaaagccgtatcctgcttgtgaactgcgaaaaggtttttagatactctctccatgaggtttattatgcaattattatgcaatattgaaggaaaatgttgatttctt<br>attgtggcttgctcagcaaaaggttgtgcctaatttgcactaattgatgtttaaaaatgtcacttcatattatgtgaaggcaaaaaga<br>tgatgtggcttaaatgttttgcctaatttgcactaattgatgtttaaaaatgtcacttcatattatgtgaaggcaaaaaga |
| Contig40_gene_232 | 767 | atgaaaaggaatatttatttattttattagttacactatttaatcagtatgagtgttgtcagcaaatgatgctgatgtctctta<br>tattgatgaatagtttcttgataatagtttctgataatattagaactttctgattctgaaatggcattctggatatgattatgatcctgata<br>tgcttgaaaatgaaatcaaggagaatggattgtcagataataatgatgttcttaaaagtaattacctgaaaatgaattcattgaagatcaaattat<br>aatgagtattatgaggatataatcaaggagataagattctaattccaaaagtatgggaattcattaattctgattaacaataaatcattgaatttagaga<br>aaattccttaagtgaagacggttatttcttttcttatgcaactaagaactatactcttcggttgatggtgtaaatataatattacactatttaaaagatg<br>attattatttgtcttcaaccgctgaaaaatcaggctatttgtaaatgagagtttcgtgtcaggttcaatagaagataaagttgatatctcctc<br>ctgatgaagaattcctaggatggctgatgtgctaaaccgctgatgtgaaccgctaactataaaaagttctlcttagttaaggattatgatttgtaactccagtgaaag<br>agtagtcaatctgaaaaayyaggatctctctctaaaaygtclcctaaaaygcaatctaccaaytictlatgattctaaaatctacatccaaccattat<br>atcagggaaatactgctaattgtgggcttttgccacaatgctgcttagagtccatatctcttaaaaactgaaaatacatcatatacccttcc<br>cctcaatgggattctctgaaataatttgaagaatgtgatggtttccctttggacgaacgtacagataagtaagtaatagtggggaatat<br>gttaatgtctttagcatatctttattcgttgagtggcccttataaatgaatcagatgatccatataattctaact |
| Contig40_gene_248 | 768 | atgaaaaaatggaatggctagttatatttctgaataagctagcagcaaatgatgtatattttaatccagctgattgatagt<br>ctatgctatagctatgtatgcatacattttagttcttcatttgtctatttaaccatgtctaaccaataaaagaagaagaaagaa<br>gagaagaaccattacaggttattaa |
| Contig40_gene_251 | 769 | atgcctaaaattgcaaattatgaataagctagcagcaaagaacattcctaggctgtttgctgtgtaattttagtctgtcttcattgccgg<br>attcctaatccctatgggattgaatacagatcaaatctacactcgtccgcacctgaaaatcgcagcccagatcttggctggataactcatatatgact<br>ataggaggagagagttttagagtctccaggcataacagaagccaatatcctgaaaatcgcagcccagatcttggctggataactcatatatgact<br>ccaatagcagagatgcttcaaggagatgctcaaggtatatccatacttttgaaccaacagtatctcgttcatctccagttgctgtcttattgtgatgaatcctttattatac<br>aagaggtttcgatacaacatccctgaatcctccattctgatgcattcataatcgcttcatgcttgcaatcaacttacaatgataggacaa |

FIG. 7B-41

| | | |
|---|---|---|
| | | aggatgaaaggatattgctgaagatgtaaaaagagccattgccagttctgacagactagccaatgaggttgaagaagcaatgaaggctcgt gaaaacaagccaaaaagagtttaggtga |
| Contig40_gene_252 | 770 | atgttaatctggctattggttattagttgcatagttcattagttcattagttcattagtttacttttgaagcctcgcaactgtatgggtcctgagtaaggatccagt tattagaacaataaacagaagttgcatccgtaggagttcattagttcattttgttatatctacattgctcttttgacattgattgcaa ctacaatcattgttacttactcttgtttagagctattctcgcttagagatagagatagggctgatgtataa |
| Contig40_gene_260 | 771 | ttgttcgctatagtaagctatctgcagtcgcagcgcaagcgatgattttcaagttccctgctgatgactctgactctgatattcttgctattga cgatattgcacaaaagacagttctcataaaactgatgatgaagaagacattagtgttgaattgaaattgatgatgggatgatgatactagct atgattcctactatgacgattcctagccattgtgatgactgtcaacctatgagactgtcaaactgaattaattagtgaagctgtattaactaaa atagaagtcttgaatgtcctagattcctatgattatgatgtctattcattctcacagatgaggatgtgttgtagtatatctcatccctgttaagttgag tttaggcctcaggattcataagatttcatatgattttatgaggatatgatgttgttaatgaacatggtatgacatgtattaaggttctttggtcgttctaaagtgag atttctctattgtcagcttcagcttcaataaagattacaaaacaggcacttattatatacagtataaagttcttggtcgttctgttaaggagt ccaactgttccagcttcagcttcaataaaaatcaatctcacatttcaaatgtaagaaagccacagtgaagactaattccaaaggaattcaaactatgcccttaaat cttatcaaatcaaaactattcagttacagcagctttggtttccaaccactgtgaagccattagcaatgaaactcaaatcaagcgatcataag ttgcacctgaaactattaagcccttcagcttgtcaaccactgtgaagccattagcgcaaaacatcaagtccagcttgaaaaacatcaagatcattaag gctccaggcacattagcctaagccattgtcaaccactgtaaaagcaagaagtattccaaatcaaattgacaaattccaagacaaaaaagc cattggtggagttaagcttactgaagtataatctgaaggatatataagacagttacagttacagtaacaaccggat |
| Contig40_gene_261 | 772 | ttggaagagaatccaattgattttaaggataaattcaatcaattctaaaggatacgattacgagcatgcctctgatgagttgtctca agacttatacaactctgcaaggaactggcgacccaagagaagtgattatatagacgttgagcaattggaagtgtcttttcataaatgtcaca acataactctgcaaggaactggcgacccaagagaagtgattatatagacgttgagcaattggaagtgtcttttcataaatgtcaca gctcaatttacaatttaactacactgcttgaatataacaatgggttatcagataattttgcgcggtggaatttgtattgaaaccgaaatacatgtgataattg tatcttcataattattggaaaccatgcagatcatgatggaggtgccgttacaacatgctatgtgaaggtccgatatctataattctgtatcattaat aattcagctgtaaggatgcggagcaatccgtgtgaaattgacagcattgacagcttaagcgttatggtaagcgttcaagcgtcaggagtgtccaggactgcatattcattgaaatcatgcagatga atggcagttgcctattatagctggctgaccaattcctaatcgtaatcctatgaccaatcctaatcgtaatcctatgacacactgcaggaacaaatggcggtgctgtaa tggtttccggaagccttaatcttaccaattcctaatcgtaatcaacattatatacaacaataattcactctcttaggaagaaaatcttttaaaatgaacgctacccca gatgcaaagacggtcataaatccaataagattgggagacgaggacccctagcaggccctgatgtgttgacccta attattattcctaattcaacataacgattgggagacgaggacccctagcaggccctgatgtgttgacccta |
| Contig40_gene_269 | 773 | atgaaaagaagatataaagtttattctattggccatcttaactataataagcattaatgccattcagctagcgaaattggcttagatgacaa taatgcaatagatgagaatgatgattaaaattaagcaagacataatgtctgaaaagataatctctgataatgaggatgcagattcaaataatg caaatgatgtgaatacagactcatccgatgaagtaaatgagataaatgaacaaaatacagacactgatacagttgatgaggatgaagaa gatccaatcattccagtagacactagattattcaatccagatctgttataaaaggaaaacgattaaaacattgttctaaaagacatcgacaacaa tcctcttgccaatcagacaatcaacttcttttatagagtatgacgatgcgatgaataaaatattaaaacaatttgtatttgacttaaagtgataaagcca taagccaaagactcacactttcttatagagtatgacgatgcgatgaataaaatattaaaacaatttgtatttgacttaaagtgataaagcca gttcaaacaaaattaagcgtaaagtcaacaattgtgtataaaaacatacacaagaacaactgacaagaacaataatggtttatttaaaaccagcgacataaggcacttgcaaa ccagaaaataaaaattggattgccgaaaaaaacataccccaaggcaaagtaccccacaagcaagaaaataaagcttgaataaatataaaagattcatgtcttttgaaacgaattgcttgga catcagcataaacccttagctacgcaaaggcatgacggcaaaggcaagcaaataccccacaacaagcaagaaaataaagttaaaatagcttatgtggtgacttcatgttttgga tccacatactactggaaaggtgaattgcttaaggaaggtgaattgcttaaggaattgcttaaggatgggaattgcttaaggattgctaa

FIG. 7B-42

| | | |
|---|---|---|
| | | acatcagatacacgatgaagtttacaatatcatgaagcagaagacttcaatgcattattcatataatgtctata |
| Contig40_gene_296 | 774 | atgctctttcagtaattgctactgtatctgctactgtaacgtaatcgttattactgatcctagtggagagatcctaacggtgctgcagcagg<br>aagtatgtccttgcaaataacatgttcagtcttcattcatcatgtctaaagatgatgagcattgatacgccatgctgtgccgctttcaggggtgaagtaatgta<br>cagaaggaactatgcgattattgcagcgccttcaatggtgcagctatcggtggagactataacgcttatctgttgttgtcgacgatgccgaaccattaa<br>atccgtctgttattggaggccctcaatggtgcagctatcggtggagactataacgcttatctgttgttgtcgacgatgccgaaccattaa<br>ggtcaccaccacacagagagagtgttcaattgcctcaaggttccaaaggaaaaatgattaggatggttatcctgccacttatattgtcggtaaggccatg<br>gtactgcagaaagagtccgaagagagattcaggtgaaaaatacgtggggtgcagtaaaccttgtttccagtatcagtacggagacatgtttgtgccgatca<br>aagaggttgccgaggttatccgatggatgaactcgtgaactattccaaatcctgtacagaagaggtcgtcaaggcgtcagttaagaaatgtgtacagttttccagatcttttctgtt<br>acgttgccatactgtgcagtagattaggactctcagacattacagagaggtcgtcaaggcgtcagttaagaaatgttataatgcttcaaccat<br>tcagttcacttaacaaagtattaacaatgttaatcgttggtgttgactatgtagagcaagcgacttaa |
| Contig40_gene_297 | 775 | atgtttattaaaattagaagagacacttaataatattattgcttttatttaattctatgcggtagattaattctatgtagcttatgc<br>atcctctgctcaagtcgaagaaggcgtacctattgcagtgtattatcgttaaggaaacgacatagttcctattgacatataagatataatgttg<br>aaaattcagtttaagagaaggcagttatatttgatggagacatccttaagacctctacacgggagctgctgactgaagcgaggcaaatgca<br>gagaagtttgtaaaaagtcaacaattccagtaccactcagtatctcaggtgacgtaatgtaaacaagcaaactgtatcgtaac<br>cgttactgttattgaagattctcaactattatatattacaggaaacagtaccacatctgatttcacagaaacgaaccatcaaaagtgttt<br>ataattatagcttagcaggttag |
| Contig40_gene_306 | 776 | atgaaagcagtcattcctgcagcaggcttgaacaagatccttcctgctactaagctcaaccaaagatgttgccgtttatgacaagcc<br>gaccattcaatatgtaatagaagagtctgtaaatccggtgtagatgatattctaatcgtaactggtaaggtaaagatcaattgaagaccatt<br>ttgacaggtcctcgaattggaacaccattgaaaaccaaaggaaaatgatttcctaaaagaagttgaatatattcagattggcagatatt<br>catttataagacagaaaaagcaaaagttcttggacttgcacaaagcatgtgctaaaaagcatgcggcaatgctgatcctttgtttgtcatgttagg<br>ggataccattacaaaggtacaagatacagtatggtatataatagcggtgaagaacaattgaacatctatgaaaagtatgaaaaatctgttatcgccctgaagaggttc<br>cggatgaaaaggttgaaagtaatttggctattgtgtatatgagcaagcttgatgagatgtccttacacctgacattttgattgaaaatgtggagcctgatacgtgg<br>agagtagcaccaagtgactgatgcctttaagcaagcttgatgagatgtcaagtgatattataaaagataggagtcattaaagaagagattattgatt<br>ggctaaagacttcctaaggtttgcattggaagatgacagtgcaagagatgataattgaattcattaagaagagattatttaa |
| Contig40_gene_310 | 777 | Atgaattgtagtgtatatgaagattgtaagttgaaaatattatcacagcagatctaaattcaaattctaatgcttaattcagattttgcttatgg<br>tgattcagattctgaagaaatcttgatgaaaatcttagatgaaccctctaaaacaggttctgattcctcgatttcgtataaacatcacattaaagtcttctt<br>ataatgctaagaaacattgatgtaattgagcttgagctcctaatgtagcggaacctatacaggtgattctctaattgtagtaacaaatcattaacattaaagtcttct<br>tcaagtgcaacacttgatggagaattctcaaatgtctataaatgctcaaatgtaatttgacggctgtataattgtgacaatcaacactttataatgcaaa<br>ttacactgtcttagtgtaaaatgtaaatgtaaccattcaaatttttacaaataatgttcaaataagtccagctgtcatacgatggagagttagatgtgccttaataa<br>tccatggataatgtaaatgttattaaactctaattttataaataatgttggtataatttttgaaacatcctcatcaggagagccatttggat<br>cttattgggaaacgatttgccaaatgcaaatgcgataatttgcagttttataatttgggtttataattttgaaacatcctcatcaggagagccatttggat |

FIG. 7B-43

| | |
|---|---|
| | aagggaaataatattgtaattaacaattcatattctttaataattcagctaccgctgaagttgatgacattccatggagaggagataacct<br>atttggcagatgatatgggaggagcagccttttagttgaaaaaatgtaaaataatcaattcccttttgatagtagccttccatgcacaa<br>gggggagcattgtattataagtctgcatatgattgttcaataatcaaccttttaaattcattttctgttggaagggaggcgtaatcta<br>tttaggtcagaatattgatggctaatgatagatccttgtaattttataaacacactgcagacgattggatg |
| Contig40_<br>gene_317<br>778 | atgattaaaactgatgtattggttattggtgctgaccctgctgttcttcagctgctagatttgcagctaaaggcggctagatgttattcttat<br>ggataagaaatccgaaataggcgctcctaaaagatgtgctgaagtgtatccaaaagactttgataagttagacctttgaaatgatcctcatt<br>gggttacccaagaaaattgcagggtcagattagtcgctcctgacgaactgatgtatggcttgatgaagatgttattgacttgcctgaagcagga<br>tatatcctagagagaagaaagtcttttgtaagctacatatggctattgcaatatgcaattaatgctaaataattatcggtcagacggtc<br>gaaagagaagaagatggaagcttcactgtagcttgcctgcaatccatggtgaacctttgacattaatgctaaataattatcgtgcagacggtc<br>ctgaaagccatgttgcaagatggctggcttctgaattctacttggaagcgtagctccctgaagtactttctgctttcctaaaggagatgacattgtaacgcaaa<br>atggaaaagagcaatgttcttgaatctacttggaagcgtagctccgcttacgaatactttgcctgatgctgtaaacaactgtttgagatcagagatgacattgtaaatgc<br>aggacttgctatcattccagatatggctgaagataaatccgcttacgaatactatgtgctgtaaacaactgttatgctactaaagacgctc<br>agcctgttgaattgaatgtaggggagacccctgtaggcggggcttgtaaggaaatgtacggcgacaatatcatgcttgtggagatgcagcaagc<br>caagtaaacccattgactggtggaagaatcaccaatggtatgatgggcggaagatttgctgtgaagtgggctgctgaagcttataaagcaggga<br>ctgctctaaagactcccttaaaagatatgaagatttagttaagaagaatgggtcatgaaatgcaaaaataca |
| Contig40_<br>gene_342<br>779 | ttgagttctaatagtttaagttctaatgtttctaagtttccaattccaatcaattaaattctaattctattctaattctaattctaa<br>ttctaatcaaaagccaattcaaaagatttcgtctgatttgctcaatgtctgatttgctcaatgataaaacttaaaagtaaacgaactgaagaaaaatatttataa<br>agcttgttgatgcaacgaaacatcgcttataatttctgttgatcttatttaacatagattcctcaattgaattcgttgagtgtaccgttcgaact<br>gatgaaaatgcttatctctacagtatccgttatattcctcatatcgttctcatatcagtcattacagtctatctgaaggtgatgaaatcataatcc<br>ttccagcacttatctctacagtatccgttatattcctcatatcgttctcatatcagtcattacagtctatctgaaggtgatgaaatcataatcc<br>agattacaagttgcgggagcctgtatccaatcagaaggttcttataagactttgataataagaatatactgcaacacagattcagaggtatt<br>gcaaagtaaaactaccaaatcagaagaacctattcaataatcctgtaatttttcaagaaaatcaacattaactaattccaaagtgcacttacctttaaggagctgaagaa<br>tattcctgttttataaatcgcacctaagattattgtgatggaaggaataataataaaacaactaattccaaagtgcagcttccataaatattgat<br>agattctatcaaatcgcacctaagattattgtgatggaaggaataataataaaacaactaattccaaagtgcagcttccataaatattgat<br>ttgaaaggggaatacaaaagctttgaatgtaaaaagctttgaatgtaaaagctttgttatgtccagtaagcaattacactgatttgaatgttgtagatcc<br>ttcaggccaatacaaaagctttgaatgtaaaaagctctgcttcagctaagcaagtctctgcttcactgcggaggat |
| Contig40_<br>gene_344<br>780 | atgggatttgtattaatctcctgtatctgtattgatgaagcaagttcttcaagtgcttatcagattctagcattcaatgatta<br>tttagtagcaaactctggagatgattctgtagctagtttcaagtgcatctagttcaattgctgcagatgattcagatcttctaacaatgctagtt<br>caagtaatgttaatttcgaaaatgaagttttaagtactaataataagagataccagaatccgaaattgtaaggattctaaaaatcaattgtct<br>tcatcttctcttcaagctagtactaaaaccactcttaaaggcagtgactttaacatccttgcaaaaattacactaggacaatccatattatgttacttttaac<br>tgatagtaatgttaagtttagctagtcagaaagtgactttgcttatatgcagaaatacattaccggacaccgattcaaagctatctgtagcttg<br>ccattaacattaatttagccaaagaagtataacattaccggacaccgattcaaagctatctgtagcttg<br>acagttcagttcactcagtaaggtgacctaaatcaatacagtggatcaaccgttaaaaagaaatgcttattcagtgaccttgactgatgaatggaaa<br>ggcattatccagtcagaagaatttaccttgactgcatccatgcggctctgcatcctatgcggaacctctgaaattataccagaattataccagaccacgattcaaattgctcaattgcaatcaatt<br>tggctgcagtaagaaatttaccttgactgcgaaccttgactgcatccatgcgcgaactcgttaaggaagggaaatacgttactgttcaaaaa<br>ggagatacaagcataaagatctcagcaagtcctacagcagaaccaacaaactcaaatgttgtgcttcaattg<br>ccaaagtcgccataagatctcagcaagtcctacagcagaaccaacaaactcaaatgttgtgcttcaattg |

FIG. 7B-44

| | | |
|---|---|---|
| Contig40_gene_346 | 781 | atggaggataatctttgaaaatagaaaactaatttgataagtatcttccttgttagtctgttgcaattctgcttgaagcgcaatgagga<br>tgtggataatggacttatcgatcttcagtactctatcttgcactctatcttgcagtcactctgaagtctcgattctggatctgcagtcag<br>ctgaagtctctgattccactataggatcagactctattgaactggaagataaggtaatgtttaaagtcaagtgataatgcttctttgaacta<br>gatgataaaataataattgtttcttgaagacgattattgagacctaaagaaagaatgttcttcaatgatgagaatgc<br>atggttttatatatatatgtgtggtatgatgtgatgatgagatttgggtttccctgatttgtagatgatttcaatcactactactgat<br>ccatacgattaaacagttatgacactccatttgacggtgtggattggttggctgttataatgattatgactattcaatcactactactgat<br>gataatgggactgtagttataatgttccatatgaggttgaattgggcactgtgtataggaccctctaaacgacttacgacttttatgtctctgtgt<br>tggaaattgggaaagttacacacaatctgcgcagtggaaattgggcacttgttttacaagcgattccaatcaatatgtcggaacaatagatgaaatgaaaga<br>ctgatatggacacttatgaaagtccaatggcacttatgaaggtcatatatgacggctatttcattcttaatcttcagattctagcgccattga<br>gcaatcatacaaagtcagctatgtcagtcacttgtgaaggtcatatatgacggctattattatgtatgtagatagta<br>gttctatgacgaccatcatacagaccctgattcacttgtgatgaaaggatagattatatgtatgtagatagta |
| Contig40_gene_349 | 782 | atgaacagaataaaataattgtttgcttgtattattgatagcagttggcttgcagtttgtgcagccagcagcactacaataaa<br>agtaggcaattacaagatgttggaaaggagatagattcaacattcaatgtgcctaaggatgcacagtatttaaaaggagtttatgctgtaa<br>tattctatcacggcaagaatgtgacgattcaggccacatactatgtattgtctaagataaggtatattataagaataaaaaggcaaaatc<br>gtaacaagtctttctacagctaagaatctcagcggacttagcatactttccactaacagtaagtgttacactccttataagatggatgtaag<br>ttataggaagatgactaatgctgagaaaagaaaatttgtggcagtttagtttattag |
| Contig40_gene_352 | 783 | atgaaaaatcagttttaaaattctaattgctttagcttcaattgctgtatcaattgttcatctaatgatctctctgattctaatgt<br>ttcaagtgattaactgttgattcagatctgtctctataagctctgatgatacaagtctcagatgattcaagtctcagatgatgtat<br>ctcaggataagactaatgatataaaaactgtctgattccagtcaaaagatacttcatcaaagatactcaagatactgatgataatacagataatggt<br>tctgataaatgtaatttgattatcacaaaaaggcaatgagaaagtcaaagttgagatcgtagagtggacaatagagtaaaaactcttt<br>aacactgcagaaaaacatctctgttgatgagttcctccctccaaaactttgagttttaagctctgctaaggcaagcaaagaaactatgcagttgaga<br>tagcaaattgggacattggaaattaaggaaaaatgaatctgctacccttagtgattaaggctcaagcattaaaggctggaaatttcaccaatgtg<br>gcaaatctcactacagattccgatatatcaagtgaaaggtccttagcgctaagcaagatgtggaagtgcttccgagaataaaagaatgagac<br>tcctgtaggacctaagaagaacaaagataatattctacagtcaaaagattcataaagttcataaaatcagacaaataatacaaatatgactc<br>caatagattttaagaaatctggaaattcattgtttgctgttataataagctgcttttggctgtctgaatatttttaggacgaagaagaataaat<br>tag |
| Contig40_gene_359 | 784 | gtggatttgtctgattcttgttgtgatactcttatttcagatgttctgatgttctgatcgtgatgattagttagtcttagcgatga<br>aaataataatttttaaatttgattaaatgataatcacatatgattttaattagatagtaattatgattagtaattatcttatcttctctaatt<br>caaattccaagtccagttccaatacacatgtccattaacatgccatttacttacttatcagatcaaatccgtttaactttctcatataacttgaatgaggc<br>agctttgaagatattcaatctgcagttactgtctgatgggatgataatatcctaaaacatatcaaagattttctttgttgaacagatgggtga<br>aataaataagacattaactttcatcaatggaaatcaaggaaacgaaaagtgataatgtggccttatcaaggaaacagttaactgcgcaggggacaacgga<br>acttaagaatctaacttcatcaatggaaatcaaggaaacgaaaagtgataatgtggccttatcaaggaaacagttaactgcgcaggggacaacgga<br>actatcgttaattgcagtttattaacaatagcggtgatgagaaagttatgcgcgtctatctcttgaaaggatcctatggaaaataagcga<br>ttccattttaaaaacagttattctgagctaatggggagcaatctatttcggaggttcttcagctatgtgattataaattccattttcattaacaactctgcagattctggt<br>accatgaaaggaaggagtgagccgctatgaagtcaagtgattaactcattggcactatgtctaaattcattggagtgattataaatgaggtccaattttatttgt<br>ggcgccttgcagctttgcgctatgaagtcaagtgattaactcattggcactatgtctaaattcattggagtgattataaattccaaataatgaggtccatttcatgtcggt<br>ttctaatgattgattagcaattccactttcattaataattcagctgatcaaaaggaggatcaattttattta |

FIG. 7B-45

| | | |
|---|---|---|
| Contig40_gene_411 | 785 | atgaaaagaatatatttttaattgcaataatactaattgcagttgttgcagtagtggatgtataaatagcctatggataatatcaacaa<br>tatgaaggaattgaacactgatattaccgaaggagacacgattatctgctatcaattatatcaataataaggactttattagtgaactg<br>acaacatccaaattgcaaagacaaattaatgatgctgatgagaagctttcaaatattgagcaatataaatctagctaaacgagagcattat<br>cttgattatttatattgaaaaggaagtttccattaaaagacaagccagcgatgaactttattggcttacaatatatacaacatga<br>tttcagctctgaaattcatatgcccaattcattaatgactcaggctaaagttttacaagatgaaagaaccaaattgttgaaaaca<br>atcctgatctattttaaaaagcaggaataatctga |
| Contig40_gene_431 | 786 | atgttgattgccttactggcttatctgctgttgcagcagttgacgctgaccattaactgataatcaacttaatccaactattttttatcttga<br>ttttaatcatggcgcttaaatgatggttttaaaaagaatttgatctcttgatatgttccaacattgatagcgtagacctttacaacgatg<br>gagaaatgtctctgtaagctttttatagtttaaatcctaccattgatgtgataactaaatgatgagattaagattatacattgaggttatg<br>gaagatcctaagccaatataactacattaaagatagtaaggagaacatatgctctgatgtgcagatgatgtcaagattaatgtgattc<br>tgtaattgacagatgaaatccagttctatttacaactgacaaactcttcagagtatgcctatctgtaaaggtttgctgatatgatggatcatc<br>agagtcatatatatcacgttgacaataagaaggtttactcgcgtattattatgtgtaatatagaatcactacactgttaatattga<br>tgatattgatgtgtgattattgacattatgaattaa |
| Contig40_gene_448 | 787 | atgagcgaaatataagaacttgattacaatagaatcggcgctttattataattgccatattattataatagccctgtttgaccattcag<br>taattggcagttgacaatgatgaaatagcagtaatcaccatagcgacacaatcacctatggagacaatagcacttctgccatacaagcaaaa<br>aggaaattgaaagcgaactgacttaactacattgtaaggaattgttttggatatagacatgagtaaagagcttgtgtggct<br>agcgataaattcagatcgaaattcctaataaagaactctcctaaaccaattgtaagctaattgtatattggagataaaggatttgatgaagctatcaatagcaag<br>tgccactgattatatttcgcaagctcctcatctcttggagaatcggcctttagctaagtcaaatacagacagattcttgaaatgctcgatgaaaagtca<br>caggagtcttaatgaaagtatctcaaaaacaataaaaacaaatagagcaattcaaagctaaaagccaatcaagagccaacatgctaaggactttaaagaaatcgctagcaacgatgt<br>gttgatcaggactatacttattcattaagaactaggattgattgatgaaatcgctcaaaagccaatcaatagaaaagcagctaaattgtcaatgcaacta<br>taatgaaatgaagctaaaaactaggattgattgatgaaatcaacaaaattttaacctaaagagttaattaaaatc<br>attatacagtaatcacttatccagagcctcaaaagaaattaactgagattttagtgaaatgatatttaacctaaagagttaattaaaatc<br>taa |
| Contig40_gene_466 | 788 | atggaaagatattttaaaattgttacaatcatatattgattgcattgctatactgttgtgttcatctattctgatgacattctgaaaa<br>gattggtgaaaataatcttggtgtgtgtgtgttaaggttatcatatgctataagttacataggcctttcaatctgacatcggaatgtttcaggcatgcatt<br>caaggaaaagctcatcaatatgtattgccatagtttcaaaggccttgcgtttcaaggcctttacatcctgatgtgaagattgtaattatattgttaat<br>gtaacgaaagatcctgaagactttacgaaagggacttttagttcatgagaattcttagttcatgattatgttgataagatgttaaaaagaggactt<br>tgatgttgtaatcattggacatggacatggttgcttcaatcattacaactaggaataaaatccaacctactacaagcacatccatttaaagtgataagcca<br>atgttgatgctggcacaaggtattcgttatgagattcctgaagttgatggtaaggtaaaatgcatttatagtcttatcagttagttaatgc<br>tacttataaccgattgaaaaataa |
| Contig40_gene_483 | 789 | atggataagaaacatcattatagctgcagtagctcttcgttattgctgaattgccgttgcgtttcgcatttggaggcggcgaagcagcgatag<br>cgatccgaccacttgacagtagctacacacagcaatatgcagaacctgaagcaggtttcaaccgcttacaggttgggttgcggacacatga<br>actataaaccattgtacaaagctgtctcttaagacagacaagaatgagacatatccagaactaactccactttgtcaaccaacttacattcaattagtgctgac<br>ggtttaaaatgactgtaaagttagagatgacttagaaaatcttaagacagacaagaatgagacatatccagaactaactccactttgtcaaccaacttacattcaacactgc<br>aaaagacactgaacactgatttagattaacaatcttaagaaatctacaaagaaggatgacaagctacagctaaggatgacaagctacagctaaggatgacaagaccaagat<br>ccacattcatctatgcttaaggatgtaggtatgtgaagtactgaagagtatgatgaacgctacaacgctaccgaacacccaatcggaaccgacctat. |

FIG. 7B-46

| | |
|---|---|
| | gtattgaccactgggataaagtcaacaagctatctttaaggcaaatgacaactggtatggtgacaaacttacttcactcaatcaccatgtt<br>atccctgaagaagctacctggctagcctgtagctaggctaacccggtcaagttgacattgacattggccaaccttgcaacctctgcacttaacgatctgtagacg<br>gatacaactttgttgaaagtctgcaggtaggcacaagtatctccttgcacatatcttgaagatactgaaaacagccagcaggtgcaaag<br>atcggtaacaatgtaactgctgacaagtccatcagagaagcattgaacataggtgtcaacgtgataaatctgtgaagaagtattctctggtca<br>cgcttcacctgaatataccagcgtagatacccagaagctttgcaaaccctaacgctaaagtaaaagatggtgatg |
| Contig40_<br>gene_501 | 790 |
| | atgaaattaaataaattcttcattatcagcataatatttgattatattctatcaattagtgcaataagtgcagaaaatactgataatgcactctc<br>aacagatacacactcaaatgacaatgctactctcaacagattcacgtactctcaaatgagaatgcactcacaacgagaacacactcttaacagatacac<br>actcaaatgagaatgcactcacaacagaccactcacaaggagaacacacattcttataaggattcagaaaagtctcttcatcagatgctttt<br>aataagaccatttatgtaaataaaaccggaagcgatgagggagcaaatcctacgctacactaaaaagtccattcacaact<br>tgatgactctgacaatgctgtcatctacatcggtccaggcaattacacaggtgaaaataattctgcctgaagataaacttagaccataaagatc<br>atgacggatccctagcattattggagattcaaatgaggaactgttttgatgggaaaactaaatccaataataataatcaatcagtgaggat<br>tcaatagtgacctaataatatcaacattctctcacgcaaaaataatggctctgccattagaagttctgaaatctcactattgacaattg<br>catattcacggaaaactatgcaacaaatcttgctgcacttatgttgataacatagcccttaacagtaatgaactcaaatttttagaaaata<br>gggccaaactcatgacagatatctatttccaacagaaaaagtttagtcaaagaaatacttttaaggatcaaggtcaactgcagaatattcctat<br>gcctatagccatccgtactctatcctgcaaacagaaatatagccaacattactgataatacattcatcaactgtaattatacag<br>gtatattgcctataacaatggataaatatagccaacattactgataatacattcatcaactgtaattatacag |
| Contig40_<br>gene_553 | 791 |
| | atgaagaaaaaatagcaattatttaggaattcattatgcattcttagtcatcggcatccagcgcaggtttcttagactttttaggtgg<br>cgatggaactgctactaatgatgacaatactttcttattgtcggttttgatgcagaattccctccatacagccgatacaaagacgataacgggaatatg<br>taggatttgactagcttagctcaagaagtatgtgacagaaacactggactttagtaaaacagactggatgctaaagacagcgaa<br>ttggactctggttcaattgactgtatttggaacggattaacagttaggcgttattaacagttttacgtgactttagcagttaggaacaagattctactacaaca<br>gcaagttgttgttgaagggacaacaaaaacctagctgacacccttaaagactttaactcaagttgctgactataacactgcatttatgatttagaaacc<br>cagctcttgaaggggacaacaaaaacctagctgacacccttaaagactttaactcaagttgctgactataacactgcatttatgatttagaaacc<br>ggtgcatgtgatgctgtagctattgatattgtgtaggcaaggaaatgaccaataaaaagaccaatacaaagaataggagaatacaaagaacaataacgagaccaatacaaaacttttagacgaaatgtttgaagacggaa<br>ctcatctgaacaatacgcacaaagtacgacacctacgagttcctggcgctcttattcaaaaataa<br>ctgtagaaaaactcgcacaaagtacgacacctacgagttcctggcgctcttattcaaaaataa |
| Contig40_<br>gene_636 | 792 |
| | atgaatttcaataacaataccagatgactacactattgcaacatccgatgcacactacctgtgcaaatggtgaaggatgcaaccatgccataagctttgcaa<br>cactttcacaataccagatgactacactattgcaacatccgatgcacactacctgtgcaaaggatgcaaccatgccataagctttgcaa<br>ccggtgcagcgatgatatagaagcagcaaaacaaattcatcagtcaagaaaaacattgcttaaagaagaatcatgaactataatgacatg<br>gacatcaccctttcaggcattctctgctgatgttgatgaaccaccattatatgttttata |
| Contig40_<br>gene_721 | 793 |
| | atgaaaagatcaatcatcatttttaacaatcatatattatcctattttagtaattggctatcaagcgctggctttttgattttcaagtgatga<br>tgctggttccggtgaaaatactgatgatgtattttgttggattcaacagcaatttccaccattggatataaggaaaatggtgaatatacag<br>gatttgacattgacactggctaaagagttgctcgaagaacaactgacattcaagcaggtgccaatcatcgattggaacactaacaagatttgaa<br>ttggacacagcaatgaagttgagactgcatctgagtgaattacccattacgcaggaagaggacgactatacatggtcccaacccttacttttaacaatac<br>aagcttgtcatcgttagagggtagaggggatagcatcaatgacctctgaagattgacgcaggtgatgatgaacgcaggtcatcatggaacactaaggaagctccattctaa<br>acacaatcgaaaagaatgagacttaaagagaaaattgcaaagatataatcaatgacctctgaagaatgccaagatattgaatcagacaatttccaa<br>gtctgtgatgtgataatcatagacagcggtcttgaaaaggaaacactgaattaaggagtaaggttcaaaagacatgatgagactaaggaagttcaagaagcatgcgatgtatgcgatggaaccgttg<br>tgagaaatatggtgttgcatttgaaaaggaaacactgaattaaggagataaggttcaaaagcatgatgagactaaggaagttcaagaagcatgcgatgtatgcgatggaaccgttg<br>aaaagatagctcaaaagtacagcaaatacgaattccagatggtgtaatctatcctgaataa |

FIG. 7B-47

| | | |
|---|---|---|
| Contig40_gene_730 | 794 | gtggcataaccttacagcaatcatcacagyggcattagtgtggaactactttttcagaaacctttaggaaactaccttagccaattcatactta<br>cagctatcagataagcttcattatgcgttatcctctcacatccatcttcacatattggtagtgagatcgtacctaaaagatggcattgaatg<br>acctgaaggatatgcattgagcactgaagttcatgcagataagctcagataatgcaagcctattgcaagcctctgtaaagctccttgacagctctacaaat<br>cttgccttaaggatgtgttggcccatccaccaaaagaggatgtattccgtttactgagatgaccgagagcattgaagaccattgaagacgaac<br>aatagccgaagatgaagaggacatcatcaaaaggtattccgtttagatgtaccaagtagatatgtataagttgatataatgaaacgagatcatct<br>ggctagacctagaatgagatttgttcaagctaaagactaaagccactcagcaaatattggaaggagaaagatgttgacattagagctaatctccattagtagt<br>ttcatcggtgttgttcaagctaaagactaaagccactcagcaaatattggaaggagaaagatgttgacattagagctaatctccattagtagt<br>tcctgaaaatatgctttcatggacttgcttaggaattcaagaaatcattgaaagaaacagagaatatgtacatatgtttctgtagtggatgaattcggaagcg<br>ttgtaggactcatcacattaacgacccttcttgaagaaattgtaggagaacattccaggaatcgatgaagaggacgatcctaaagcggttgaaaga<br>aagaccatacttgctaatagacgcagatctcttcacatgcaggtaaaatccctgaaaccggtgaaatattccatg<br>cgatacacaaccattgcaggattcatccttcacatgcaggtaaaatccctgaaaccggtgaaatattccatg |
| Contig40_gene_732 | 795 | atgattctaaaactgatttagtgactgcattgcttttagctattgtttccatagctcagttagtgcatggacttgtttggaacagc<br>tgatgactagttccacagcaaagactaccattgaaacagatagagacatttcaatatacctgacgatttcaatatatcctgaccgacatctctcaatgagtcatatgttggata<br>atgaaactaccaactcaaatggcgtatttttattcaactgcagagagctattaaaggtgcagatgataatatattcagtagcagac<br>tacagttatcctggttatgaagctaatctgaaagcttcaatctgaaagctgctaaaaggttggagataaagaaacatcaatgtcatgaagttt<br>aattgcagaaaatgaatttgatggcttaaagttcatgcattttctatgctgaagatgagattgtataactgtataacttcagatgataatt<br>tattgaacaataatcctgaggcatga |
| Contig40_gene_733 | 796 | atgaatgtgaataagaaatattttactgtaatctttatatatctatttcaatagctcggagtatattgtgcagacatccatcaggatagcga<br>tttaaccgcaattctaagcatgcaatgaaacagtagtggtttaacacagtagcaatcatgagcaatgaaacagagtcttggctgctgtttcaattgtcctcc<br>aattagatgaatgatccataatgtcaactaacatgtctaacacatctcttaagcccaatatttattgaaaagtcaattgtcattcagttgaaagcct<br>gcaataaagcaataataaaactgcaataatatctcaccatgtcacatcacaaatgctggataataggataggagtaggtgaatagacgatgg<br>aatcgacagtgaatctgtgaaaactcactgcaaagtgaatctcagagagcatccaaagatatacgcttgcaacacctgaagattatctaatcaaatccaggagatta<br>aaagagtatgaaaggtcatgttgaattaagcttcatttgtaattatgagcttccagagagaagataattaattacttatgaagttctctcaacactacaaagctcaagacaggacattaaac<br>gttggagaataacatcaggacatgaatctctgcgaaggtcatttgtaattatgagcttcagagaaggataattacttatgacgactgataattgcaacaacataacgacatattaca<br>tctatctagaactgaagatgcactttattgagatgcagaccatatacgttcaatgagctttgaagtagataaactatctgtttgacataataaagtcaataatgtaactctcaataatgtctaacagattttagcattatagttgtagg<br>tatccaatagctccaactataaagcctaggttcatgactttattgctgcttgaagtagataaagctacaatgtcaataatgctaatcagacagattttagcattatagttgtagg<br>cctagtcgaactgaaatgcgtagtctcagacactcttattgctcttattgtcttcaaagtgcaataagaagagacatt<br>agtagttcgtagttacagcacttcttgttttataaagtcattgctcagcaagtgcagcaagtgcagcagagctttaaatcaatgatggctttaacagctcactgtcgatta |
| Contig40_gene_749 | 797 | atgatactgcactatttgtttataagtcattggctcagcaagtgcagcaagtgcagcagactttaaatcaatgatggctttaacagctcactgtcgatta<br>ttcttttacaatgaagaccaaaatgtacattaatacttgtttgtttgcagctataacgatcatgtaatctcctatattaccaaagatat<br>atcgcatagttcaggagagaacaataaacatatactatgaaaatagtcgaagttgagatgatgcaaaagcaaatcatttgtttcaaagaggacataatgatactcctaaaatctggaattcttagcgaagatcatgtatcaataatctaataatctggaatctcctatattaccaaagatat<br>gttgccttagactgtgagtgggtattgaaatgtagctgaagttgatgcaaaagcaaatcatttggtttcaaagagaaacaatgtagatagct<br>gaaaacatgttatgatgaattcaatcagaacaataatatagagcaatagcaatagcaatgatgcagatgctatataa |
| Contig40_gene_750 | 798 | Atgatctcactgctttcatattcaattcttgctataagcgcagcaagtgctgcagatgacatgtgcagatgacatgtgcagatattgacctagcaagttcaga<br>aattagtgaagtagtgtagatgatgtagcaagctacagataaatgtttatcctgatgcagatgaaggtcagtagttcagtagttacaaaactccttttcagtagttacaaaactccttt<br>tcaatgaaaaatgcaactattgatatatcagcgtcaacggcacttagctgatgacaagcaccataaaactttcattgacgtgaagacaaaggagat<br>ttaatctctatcagcagaaggaaaaccagttatgttattccgcaagcactctcgatgtaggaaaatattcattgaagcagtagtacataatgg<br>aacttcctcattggaggcagatccaccctcaactattactaaagtcactcctctcgtaagcgttagtgatgtaactgtaaaaagtggagattata |

FIG. 7B-48

| | | |
|---|---|---|
| | | taaccattccatttaatgtaactgatgacaaagtaaagcaatccctgagatgtcattgtaacaatagtctggaaaatgatgtaataagcaaa<br>catattaaactaaacgacaatagctctgcaggattaatatgctgatatattggaatattggcggaaacagccaggtaacgaacaggaac<br>tggaataggtgacttattcaacagaaacggaactggaacggaactggaacggaataggtgacttattcaacagaaacggaa<br>ctggaaacgaacggaactggaaacggaactgctatattcaacagaaacggaaccggaacggaacggcatccaggtattgcgaaacagc<br>acaggtaacggaactggaaaaggagtctataagtgaatacttgaatcgttgaatacttaagcaacagaaactacaatggagcca<br>tgcatatgtctttgaaaaaggagtctataagtgaatacttgaatcgttgaatacttaagcaacagaaactacaatggagcca |
| Contig40_<br>gene_762 | 799 | atgaagaaaaattgctttagctgctgcttgcgtgtatgagtcaatggttgttgcaagagttgcagttcagttcatgatttgctattgacgatca<br>tgagattttatctatttgtatggttcaacttctgcaaatgtgaaggattttacaagagttcttgataaatatcctatttagcaatcaacggtt<br>gtgaaggcaactgtgttgttgtaaaatcttaaagaaaaggtgttgatattgtaggagaacctaatgttggagatatttagcagaaactgaatac<br>aaggctaatgatgctgcaaggttgatgatgaaggttgatgatgaaggagaatctgttgtaaagatcttgtaaggacattgtaaggatatagaggatataaaattaatgaattaagtga<br>ataa |
| Contig40_<br>gene_766 | 1376 | atgttaaaaactaaattatgcggaattagtttaaaaaatccaattagtcgttgctgcagttgtttggaagccatgcatcttctcttaattggat<br>tttaaatctgtgtgcaggtgcagttgtatccaaagtccttctcaaaggaaccaaacgaaggatacaaaaatccaaccactgtagctgttgagggag<br>gtatcataaacgctatcggactttcaagccctgcgttgatcatcatagaaggaactggaatctgtaaatagaatcaaaggcagatcaatcgct<br>tcaatctatgcaactcctgtgaatttcatatgtcaggcaagatttgaaagtttggttgacatgattgagatgaacatatcctgtcctca<br>tgcaatggaaggatatgggcttccatggttccaaatcctgattcaacagaagaattgtctctgcagttaacaagaagatactgtcagcgttcctgttc<br>ttgcaaaattaaccccaaatgtaacaaatatttctgaaatcctatttggccaatagcttttggaatgagcggccctgcaattaagcctattgctgt<br>ggcctgaatgaaaatagcattttatgacgttatgaagcaacagaacattccatattattttgaggcaagtgtgaggcattgcaactacactgatgttgtagttcttgtatg<br>cagtgcagtgcagttcaaatagaacatccattatgtagaagtcctgaaatattttggcagaatccgcaaatga |
| Contig40_<br>gene_769 | 1377 | atgaaattgtattatgtgtaacaggcagtgtagctgcagtgtagctgcagttcatcatcccaatgtcgttaagttagcttgtaattttaagcgtcgtgaatttagtcgtcttaggccattcagtcaaagc<br>atttatgaccaagagagctacaagatcattcatccaaagctcagttgccttcatccaaagcttagagtttgcaacagagttgtcttagagcttcactgaaagattg<br>agcatgttaaatattctcaagcagcactaattttagttgctccagcactgcaaatacaataagtaaattgcttatagaattcagataatcct<br>gtaaacacccttctgataactgccatgccatgggaattgttttcttaaatccgcttggatgaggcaaggcaaaattccagctattgatgcagtgagtgagaa<br>tgtggcaaagctaaagagaagagaggaattgttttcttaaaagaattaactgacgatcttagatgaaagcgaagattctaaatatggaaatg<br>aatccattcgcactgttaatccgttaatggggttaaatggttttgataagttttgataagctttagccttatgagcgaacaatttgaagaggtgaacattgaagagatataggggaatatccaatagtcctctgg<br>taagatgggtcttgaattggtcaaaatccagctagcgttatgagcgaaagacaattgaattggttccagatttttgatgtattcattgccactgctgcagtt<br>tcagactttgctcctattgttaaggaggattataagatttcttcatcatcaaagattttctgagtcgaactgttcaaagattattcatca<br>gataaagagattaatccagacatattttagttgattgaaggcagagtatatatttccagaggaagaatga |
| Contig40_<br>gene_776 | 1378 | atgttaagtatgctagtgtatgtgctagtgatgttaatgatacatataatcataaatgattaaaatcgataatcaagataattgtattaa<br>ttatgaaaagtagtttatacagagaaaaacttagaaataatttcaactgaagatttcttggaggatagcaatttctattgaaccgtctg<br>atcattaacacaaaaaattccttaatgaaggaaattccgatgaacgttaaatccagaaatagatgttgcttttgaattcaatccatgttaac<br>gaaactgctaagtcaatgttacagttagaaatgctagcggatatgtttagtctcagtggatgatcaatcttttaataaagacctactgatta<br>tcaggctagatcatctctgttgaaactaccggacttggctttggaaatcacaataagcgagattgaaatcggtgaagtttattatgggaagttgaatattggagtaggaagatgccattattgaagtcagc<br>tggaaactatctctgttgaaatcaagctgatgttgaaatcggtgaagtttattatgggaagatgccattatgaagtcagc<br>gttcccaatgtgttgaagggatatccaacacagttgcttactgaagccattcatgatgaatgcatgcattatt |

FIG. 7B-49

| | | |
|---|---|---|
| | | ttcagttctcgtttggctgtgtaggcagctatctctgatgccacatataatgaaatgatattatgaaaacgatactgcatctgccgaattg<br>aagttaaaaagcagatccgaattactgtggagatgagaaatgagagactgtcctattgaagatatgttgatgacattacagggggagttct<br>catgacgagttgtaaacattactgtgaaattggcgattgtgaaaatatggggcaatgagaatttcgaaagcgtatgatcgaag<br>ctcaaatttttcctcttaccgcattctcatagaatatggggcaatgagaatttcgaaagcgtatgatcgaag |
| Contig40_<br>gene_787 | 1379 | atggtagtgcaacaatataatcttgcatccagtcttgcgttgaatgacacttactcagcgtaagtgcagtaagtgagtttaaacttcagcgggaataagtttgtttatac<br>tgctattgggactcagctgctccaaacatggctacattagttgtattgagaggattagagaatcatgctcttagtta<br>ctgcagtgctgtcgtattgcttatcttgaaaagtaagattttggataagaatgtaaatgcagatatgagattatgttgatgactgcagattctaatttaacc<br>catgaagcagattagaaattggcgattctgattctagaactggcgatttcactgtctagaagagagatgaataa |
| Contig40_<br>gene_815 | 1380 | atgatattgcaatattgcttgccgttgaatgacacttactgcgtaagtgcagtaagtgcagtaagtgcagtaagtgcagtgagtttaacttctccagcgagaaactc<br>cgacggaggatcaataaactttgaaaatgacaattgacaatacaagtattgaattaccattcctgacggatatgaaatgatgaatcatcaa<br>agaaagtagctgaagacgctgaagatttgtgcaaatatcagcatgcaaattcactcaaggcatgtaaatgtgttataatgtcttctt<br>acagatgggatttcgaaaacctagccgaaataaatgcgaccaagtcgaaaatacgcatttaaaggtttatacgaagaaatataaata<br>tggcgataatactccaacatcacttatattgaagatgtaaagtcgttaaagtccctaatgctgatgaaatcattgaatcagtaatgggaa<br>aataa |
| Contig40_<br>gene_824 | 1381 | atgaataagcgaatatttctatatatagcactgattttattattcccctgcttctttttctgcagtcagtgctaatgaagacattcaagtga<br>caatcatcatcttgatgagaatgtttatgatgagaaatcattttcaagataagaatatcatatctgataatgattatgacgatg<br>tcattccagttgaaatgctaatgatcaattttgccaaacacatatatccgaaatgcttatttaccccgctgaatcagtcagtgagctagtgtaataatttt<br>aataaaatgataagaacaaactctccagagggatgaatcattcatcgtatcatcgtcagcataacaataacagtggagctagtgtaataatttt<br>aactgacaattatcagtatacggagtatacggaggaataacagatttttgaagtatcatgatcagtcgcagcataacaataactgattacataacagtggagctagtgtaataatttt<br>taagtgttcaggcgttgccgtattatgtgtggtgctatctcttttgaagtattcatcttcttatgtgttcaagacagagtagaatatcttataagatgcatatcgaaggagat<br>agtaatcgtcaaaattatcgtggtggtctatctctttatgtgttcaaacagagagtagaatattccaacagattgttaaattcattaacaacaatgcaaatgcaaatgaatgc<br>tggtcgcgcgctatcgtattggtgggtcaaccaggcgatatatttgtaactcaaacgagagaaggggtgctgttatacctacggatcagatatc<br>cgtatggtaataacaccaaggcgatataacttcaccaacaatgtggtgctatcctgcatatctagaggtgcgctatcgattcaacgagagaaggggtgctgttatacctacggatcagatatc<br>acagtcgaattctgtaacttcaccaacaatgtggtgctatctcatgtatactgccaacggactgtagaacatt |
| Contig40_<br>gene_828 | 1382 | atgaaatataataaaagatatctctttatttttatagttgtctcataattcctcaagcatttatgcagggatgttgatgatttatcgga<br>tgctggtaattacactagaataattcaccttaacaatagtccactatcatgatcgatggggatatgataaaa<br>atgagaatatttatcttttagataagcaattcagctgtatgggataaatcaaaacatgctgttctaagaacttttcttagataatgcttgttctatg<br>gataaatctccttgttctaagagcatatctcttgtctaagagcatatctcagataagattcatctaacttgtctaatacatattagtttc<br>tgaaaataatatatttaatcaaatgattttaatgttgatatagatgattatttaaatcttgaggaagttattcagacagatgaacttaacttatgaggcgatttg<br>taactctctaatttcaaatcaagatgagtcttcaaaagatgattcttaaatcaagatgttcttaaataacagattaaaatcccattaagtgatga<br>aaacacattaattttttataagtgataacaaataacagtcttttaaacaatcatcctagacaattgtcaaataagaaaactttccaattctca<br>atgtcaaattccaaataaagaagcgaaacaaaccagtccgttcattgaattgttagaaactctacaatgactatatatgaaca<br>cagtgggtaagctccaatggatgcagtcctgcgttgattgttaaccagtatctctttaaacaatcatctgaatgttcaaataagaaaactttccaattctca<br>acctactgaaacatcaattcagctccgttcattgaattgttagaaactctacaatgactataataagaga |

FIG. 7B-50

| | | |
|---|---|---|
| Contig40_gene_829 | 1383 | atgtctttggagctgtctcagcagctgacctaaatacagtccagtccgtgagtttcagtgagttgacatagccagctcaaatcctggagt cgaaaatggagaattgacttacgaagcaaatcagatagtgttgacaaaaacggcgaaagcaacagatagcaagtgaaaagactgttgcaagtgtggaagt atttggtatatggatccgaagcaaatatcacttgacacaacacaaatgctttgcagactatatgatgacctataacctagacagactcaggatgc gcagacggtgaggtatatgtcattaactgtaaatgcaatcactgtaaatgccactcctatcgaaggatacacattctatatttggtaaacagataggagacaagcaagctacattaag aagggaaatatcacaatcactgtaaatgccaatcctatcgaagatacatcgaagactgtaaatgccaatcctatgatagcctgtattcatatg atgatggagatggagaccaattccattattggtaaatgcagttcatcttggtaaagcagatagcggagacaagcaagctacattaag cttggaaacgtgaattacgacccaactgtagccactgtagggtatactattatatccatcacaagttgacatattgataagctgtaaagaacatgacaaacaccttg ggatgagtccatagtcactgaaacagggtataactattatatccatcacaagttgacatattgataagctgtaaagaacatgacaaacaccttg tatacactccagggaaggctcatactcattttgaagaacagaaaatcctgcttaagtgggcataaccaataatgttcagtctatgtaacaggtctctgatcctatctctt agctctgaatatgccgatgggaaaagtaaacagttctcaaatctcattagctgcaggaaggggaagctgtaatat |
| Contig40_gene_830 | 1384 | atgcctgtatggaacacaccattcaatggcgtaactgtcactcctgttgcacattacagagaccaatccaatatgggaacctacggcaagtccaatatgg ctacggacttatcgtttacgatgttatctgacctattgtagcgtttgtagctggtgaaaacacattcacacttaggaaaaagaaatggaacactgcagtatatc caagtacccttgtagcatcctataatatgcctgaatccagcacttatgtaactacataccttatacaatgccagactttattatccaatgcaaac aacttcttaggaagactgttgcatctcaacagcacagttggatatcgattcatttgacaatatagtcgcgctgacctttagtatttgcagctag ccgtcaagctggagaagtagcctgtcaataatgcatctgatctgtgagctgacatcggaatgcagcagcaacagtgagactagcatatgctatg acttaggcaaaaacctaaggcatctaatgagtactataatcattgtggtcaacgatctaccattcgaacagttcattgttcattgttgaataac aatgttcctttcagctgagcaagcctcgtagcgaagctgtcgacttctaattgttgacgcagacaacagcagccaatgtatctactagtaaactgaagtgtaaactcaacagtcttg cggcgctcttaacacttcttacattgtcgacttctaattgttgacgcaagacactctcctctgtatatagatacattagagacatctactcaccatcccatcggcgaaagcttg gccaataacttatcgatgataacaatcaggcagtgattgaagtgaccctcactcctctgtattatagatacattagagacattgactctcaga ataagcacggcctatttgacacaatcactgtaaacgtgtaaacgtgataactgatgtgattataatcattagagcatctactctgata agaaatcgtcctattgacacaatcactgtaaacgtgtaaacgtgataactgatgtgattataatcattagagcattctacctatc |
| Contig40_gene_834 | 1385 | atgaattctaatcagacagacaattcaattgaaacaaaatctggatagttcaatagacaagtcaataatttcctcaaacagtcttgca gagtttacacagacaattcaattgaaacaaaatctggatagttcagataattctaatattaatcaaataaaactctacagatgatacaagtcaataatttcctcaaacagtcttgca atacagatataagatactgaaaagaaactgaaaagactgcttttgaaacctgaaacaaagatcaaagacgtgcaagttgatagagctgcaaagtt tctatcatataagatactgaaaagaaactgaaaagactgcttttgtcataaacattcaatttaatatgaatacaaagcgttgaaaagactcctgcattaagcgctgtcaatgtt tctctccgaaccttagtaagtggcgctcaaggttctatgtgtccaattgaacacaggctctgtcaataagcactcaagttgcactgcactgcactgcactgactcctgaactccaaca tacacattccaaaccacacgttgtgagggctgggacataccttgcgggagacataccttgcgcgaggaagcatgcaacaagagattactcctgctcaatctgattgtctatt taacattgtaaacgattcaatgaacacaccattcaattgttctcaatcataacacacactgacctgaatctactgccgaggaacagaagggtctcacccaagatccaatacccaacat atgttattgtaacaccacagttcaaatgaatctactgacctgaatctactgacctgaggaagcatggcaaagatcaaccacctgaggagagatccaataccacaacat tatatataacacaactgggtgcatataacgaaatcattgaaaacactgtatataatgtacagaggcataagcgcta |
| Contig40_gene_835 | 1386 | atgataaaatcaaagaataatagtctagtctgctgattatattgtctctctcattatgcatattggattaagtgcagtcagtgctgaagattcttcaaa agctgctgatttggacttgaattctagttcagttctgattatttgtctattcaattccaattctattgcta gtgaatcaagttctaatattgtctggataataatcttcagacactacaagattctgattctgtcagtgataaactaaat cacgattctaatagtaaaatcaaatcagaatcagaatcttcaaaaggttcatactataacaagaattctaattattcactctatttgattctaacggcta tctaaacaattcattagtgtcctctaatgatacatcattaattgtctgaatttgtctggtaattttcttcaaagtattttcttcaataccttgaccatta |

FIG. 7B-51

| | | |
|---|---|---|
| Contig40_gene_836 | 1387 | caagcttagaaacgatgcattcctaagaaactctccaatcatcactgagtttccaacgaaaactatgtatatgatgcaattgtctctaac<br>ttgaccattgaatcagacctgctaacatatctgccgttggtgattggttcaagcaatataaagtcttaaacaatatattcacaacagg<br>tcaaacggatatcctatcgctttgatagcttgtatataactgcattctgcaaacaatcaagacaatagttcctgtcagcgaagcga<br>tgagctcaaggatatcgatgaggacataactgttgaaaacaccaattccgacaatagcagttggcagcattcaggaattagcctaaggggatgccattac<br>aatactgtcgttgacaataggcaacctcgaaactccttcattttggtgttatgtgttttatatcactgaaactacaatc<br>caatacaataaggcaacctcgaaactccttcattttggtgttatgtgttttatatcactgaaactacaatc |
| Contig40_gene_837 | 1388 | atggatttttaaaaagcaatccctctattgctttattgctatgcttatgcttaagcgcagcttcaagcgatcttagttc<br>aagtccagccgataatgaaaacttggaaattgatagttttgaccaaatgagattaacagttaatacgaatacaaactatattgaaagcggaa<br>ataatttggaaattgataataatctaatctaaagaatctgtaatgcaacaaatgataaaacagaatgtgattacaatgaagatatt<br>tcagttgaaaagaataattctaaagtcttctaaattgagttctgttataaaataaacagaatcttaaataaacctaactactttaataagtggaaa<br>catcctatctaatgtaaacctggagataaacctggagatacattagattctcaagtccatcaagtttcattccaacataaggaactctaactactcttaataagtggaaa<br>gcagtgacggtgctcaattcattgattgcagcttcagtccaatatgatgattattcacaacatattctattcctgcttcaaatcctatgctcttg<br>ttacaagtccgctatctattgattgcagttcagcttcagtccaatatgatgattattcacaacaatcctattcctgcttcaaatcctatgctcttg<br>cttagcaatgtaagctattctaaattatctctaacaattgatataccgcttcaacatatctttgttgtaggatgggacatcttctgcttgtcttg<br>ctgagcaacttaatcaatgaaataattatatctcctaacaattgatataccgtcaacagtgtccgaggagtgaataatcagttgatgccagtattaccactccc<br>gcgaacttaatcaatgaaataattatatctcctaacaattgatataccgtcaacagtgtccgaggagtgaattgaatggcagttgatgaaaatggaaccactcc<br>tctccatcctctcttctgcatgcatacaagtgatggaagcggtaataaattattgaacaatacggtctaca |
| Contig40_gene_841 | 1389 | atgaagcttaaaagttttcagtcattttagcggtattgcttgttgtagcaataacttgctattgggcgtgtaagtgcagaatcagtctgatactga<br>tgtagctgccgtagctgctgragatgatacacaggcacagtatctgtagacgattctgtagacactatatgatgtttccgtagcactacgatgtatgatg<br>ttaaaacagtctgagcctgttgccctgaagtggggagagtgggctatacctaaataacaagtgagctgagatcaacgacactcttattccacatacttcaaagacgat<br>ggtactgcaactgatgaattaagtgaaggtggctgctatacctaacaagtaccatcaatgttagattatactcaagttgtatgtgtgatgaaatccagtgaattccggtagcaatatctggttctga<br>tattaatattactgcaaggatggtgaagatcattaacaagtaccatcaatgttagattatactcaagttgtatgtgtgatgaagtcagtatctatgataacaatatgaataattataga<br>gattgactcttatcatcgatcccaatttcagttcagttttatgtgtaggagcgcattcagttgtttatgtgtaggagcatattcagattatattgaaaataacaccatgtc<br>attagctctttatcatcgatcccaatttcagttcagttttatgtgtaggagcatattcagttgtttatgtgtaggagcatattcagattatattgaaaataacaccatgtc<br>tgttgaaggagatgcgcttactactccggagcagttatgtctccggagcagttatccgatgtggcttacgctcttcaaaccctcaagatgtttaaataacttgttaca<br>gcaatacagttatgctcttactcctgagcagcttatgtctccggagcagcgatttatctgatgtggcaagttatatggatccaaatatgatgtgtaaatacttttgttaca<br>tctcctaataatgtactcatgatgcaattacattta:tttaacagtgacttatgatttatggtatcacta |
| Contig40_gene_841 | 1389 | Atgatttaatatcctaatttagttagtcatctatctggctaagcatttctggtgtaagtgcaattaactatgatgcattaactaatgatgctattcaagcgattaagtga<br>tattgattattcctttactattgatgacttaagcaattctgataattcattagatgttctgatgttgattgttaaaagaaacagttgtcttgatg<br>aaatgcattttggataagaattctaaccaattagtactaacaaatcaacaaacaactaagttcaaaccaattagactctaattattatgattcaaccaattgaa<br>tctgaacattgagttcaaaccaattgagttcaaaccaattagactctagttcaccattatcaaatacacacagtctccaatcaactta<br>ttcaaaatactttgatgaagattgctaagaagtcctgtagttgctccatatgataatagaccgtcaggcaataataatatctaaaaact<br>tcatattattactattccatgccataaacataagaaacagctccataacaagtccaataacagtccaatatgattatctcaataatgtatcgatcgtgcgcgt<br>tcaagtgtccaaacctatacataaggctaacgaacagccctcgaatgtccgtacatctcggtagactcaactaataatctatttaaaactatacataactttacgattagactctttaacattaataaccacatattttgaaaacaagcttgacatactttacag<br>cattattgtacagggctaacgaacgtcaacgtgcaggtatctcttggagactcttactaataataataatctattaaactatacataactttacgattaaggactca<br>gctatatgaaacttcatgaaagtcgcagttgaaagtcgcagttatctcttggagactcttactaatactactttagacatatacctgaaagtccaatatgaaagtcgaattcaatcagtgaagatag |

FIG. 7B-52

| | | |
|---|---|---|
| | | cggttatcaaaccttcggcatggcttatggaatacatctgatgggagattataacattgctctcaataata |
| Contig40_gene_847 | 1390 | atgacaactccaatattataatctcagtaattatagtattatgtcagcaggagtaactgcatatggtataagtgaggtgataatgcagt cttcagtgattttaactgctctagtactgatctggagatactgaataggaaatactactgaaacaattctcaaggcgcggaa taaccgcaggtcaaactaatgtgctaccaacactgcggctcctcctgaaagttcctcgaagccaagtcctagcaaataagcgagccca ggttctggatcatctgcctctgcggaagttcctcggaatgcgcgaggaatactaacagcgtatcagcagtactgatcagcctatgtcgttatattcta agctaaaaacatagacagctggcgcaatcgcaattacattactgtactatacggtgacgaattattgaaggtccgagcgcacctta |
| Contig40_gene_848 | 1391 | atgcagaagtactaatgtaggttacattactgtacatacggtgagcaattacattattgaaggtccgagcgcacctta atggataattcaagcattcttatatccgtaatcatcgtttatgtatttcagcaggagtaactgcctatgacttacaaatgacgcaatactgt atttaatgacctctctgattttactcctgacgaatctgttgtgtatttgtattcgagcaggagtaactgccaagaatatcaatggaa taactgcaggaacagactctgaagtgaactgttcagcctgcaaagctgttaactcagaaaccttctaagtcaagctaaccagt tcaagttcatcaagtagttctaatactcagcaaaggctgaaactaagtcagtcgagcatatatctggcgatatgctggttcaagcaag aactcagatggcctggagcatatgcgttacagacaggaccctctgatactctggcgacatatatgtgcaacacatataattctctaaagatgatgaagacactg gttatgccatatcggttctgtgaacaggcagactctggaagatcctggagcaaacaagtaactaaaagagctattgaaggcaagacgattat aagaaatgaaactctcaatattactgaataa |
| Contig40_gene_867 | 1392 | atgagaagaagaattctaattgcagctattgcaatcatattaattattgtggagtgtattgcagctagcacatgcagatagcggatatgc tactttagtttgaatgcaattgatctcggagtaaggggaagcttaatcgttgactctgaagatatcactgcttcaaaggctcttatattctt cggcttctgatgagaatgtggtttggttaaaaattatagctaagattaagcttaaatcagcgtcagttctaaataagactgaagcactgga gatgatcagacttatttatggactaatcggtaattactatctctgcagttcttagatgtcagatctgtagaattgacgagcactaatctaa aggatccaatggagattgtaacaaatgctgttaactcatcctcggatgttcctgagccctattgtgaattatctactgcttgattccactgaac qtcatgatgaaagagtgcagtgcgatgatgaaatcaatcatcctcgatgcggctagcactctatgccgctctcccaagcgcctagcaaccttgaaagaacctttcaggttcagatgctgagaagtcagcatatcataacgaat gtcgaatcaccacacagctgcgtcttgcaaacagagaggcgaaagtgaagttcaaacttacagctgaagtcaattacagctatgt gccaaagctgtgcgctctcccaatcatctatctaattgcaaactgaggttctctgcaggtgcaggtgtcagtgtgaagatctgagagtgtcgagtt agagctccaatcagcattgccgatcatcaaactgtgagttctctgcagttgtcagatgaagtaacagctctcccagctgaggtcatagggga aacagcattgctatcaaactgtgagttctctgcaggtgcaggatctccagctttctctgcaggatatgaagataggagaatatg |
| Contig40_gene_872 | 1393 | atgttgatatcaattgtactatatctctcattgcttagtgtcagtaagtgcagctgcagcgtgtcgagatagtgtgccagtctgcggatgtgttgcccagcaac tgtagatgaagttcaaacaattgataataacaaccactcaactctcagtgtaaatgaaggatgcagaagttcagcatatgctagaaccatgcgtctttatacaccattgcatcaccaatattagcatgacttcggtgccccagaaactgcatgctctcttcaaatgcgcacttgcgtaaaatgtcagttgtcaggtgtcagctactactcttaccatgccaccatgtgcgcgactaacgcaccgtgaacggttgcaattgaatatactccctgaaggagttagcgttagtttaagttataagtgtagcaagtcaagtct taaacgtgctgctgccgatgaagtgcagctattatatgcggtgatgttgaaggttctgtaaccataacctcgtgaatttgatgtaaccctcgaattttgatgtaacgatttagtaacattagtaaccaaccctaagaacatagttcacagagagaactg tggagcagctatttactcaatgaggttctgtaaccataaacatccgtgaaccatctctaagaacatagttcacagagagaactg gtacttacacaggtgacttaagtgctgctgttaaagtgctgttacaagtaatgcacactctgtttattgctaacgtgtaacgtgttcc |

FIG. 7B-53

| | | |
|---|---|---|
| | | tacggtggtgcaatttactctggtgagagcacttctgcaaatttattagtaagcggatctaccttgaagacaactttgcattcaatggtgagc<br>tattgatatagttggaacttcctataccatatctgattccacattcaaaaacaataatgttaaaggaactggta |
| Contig40_<br>gene_900 | 1394 | atgaaagaaattgctatttatctcatcctttatcatcataattgttcttattgccgcacaacactaaatgtagttgtctcaggtagtatgaacctgt<br>tatgtatagagagatattgtagtacttcaaaaagctaattatttgaatacatgaattcgaccctcacgatgttcaagtagggatatagttg<br>tttataatgccgcttgtatgacagcccttattggtgactccagagcagattacagataggttataaacactgcagagatcaagaactaccttgtgagataaaggagat<br>aataacaataaatcggaccccttatgtggtgactccagagcagattacagatagagtcattacaattaatggccaccatgtaatctctaaaat<br>aggatatatcacttatggtaaagtcttttaa |
| Contig40_<br>gene_906 | 1395 | ttgtttgaagcaggtatgattgctcttcctactgtttgcctgactgcttgttgggcttgttaacagcttatggcagtgaat<br>gttcgatgatttaggaacagatcatccaggttatgcaaagccgaaatcaatttaaacttcgattatccatggggcttaacttttataggattag<br>gtgctagtgaaggactgtgcaagagagggttctctataaagaagttcaagaaaaactagttacagatttgtaccatcaattaagcctatggaaaa<br>acaaaatggatgagtcattaggtaaagaaatgctaaagatttcaactgttattttggcttattgtgaaaatagtgtaattctgctataagaaaa<br>ttcaatcaatggtggtttaa |
| Contig40_<br>gene_909 | 800 | atgaaaactggaaaataattggattaatattaatcatcctttctgtcgttcgtttcagttagcggctgcgcattggtgatgactcttcatctgatac<br>cacatcaatcagtgcagatgccttaatattacagaagatggaacctacgactccaaggaagaggttgcagcctatatagatgaatatcacaaac<br>ttccttccaacacattaccaaaagtgaggcaaaagctctcggatgcatggagcagcgttgaaagtagcacctgaaaatgcataggaga<br>gacatattctccaatcgtcaatcaattctcctataggccatgaatacaagaggaatgcatatagacacatcttggagctgacagcagaggccctaa<br>aagaatagtctctctacagacgacatgagtttcctataccggagttctatataacgagaagcttgagcacttgacttaa |
| Contig40_<br>gene_917 | 801 | ttggttcagaatactaatctaagcaataactgtcttcaatgaagcagaaatgagacatctggtattggtgcattagacgttgttgg<br>taacaattgtcaaatcatcaacatgcacttcaccctttagaggtgattgctatcgtgtggatccactttcattcgtgtaatgacactgtcattagaa<br>attccactttcgacaataacaatgctaaccctttagaggtgtatcatctacactcattactctggatgactactggtaccatattcaatgtagatgtttcaaat<br>aacgtgctgttgaaaacggtgaaggtaacgacacattatcgataatgttacttcaatgaaacaattttcatgaaagtaaacctgaacgtgg<br>tgagcgcattcgttgaaggtaacgacacacttatcgataatgtcatgctgtaatgtaatctaagacgtaacaatgtcaacaccgcttaccgtgaggttccact<br>caggtattggaggtgcttggatatcaaaggtcatgctgtgatataaactgtgaaaactttgaaaactagactcattcaacacacccgcttaccgtgaggttccact<br>ttcattcgttggtgacaacacctatcttgacatttcaatcacctctggctcatggagctttttgtcgaaggtcattggcgacgcactgtcttagaaaaca<br>ctgtacatcatccacaacgttgacattccaatacaactctgggtcatgagctgttttttgtggtgtgatgaattggtggcactgctgacgcactgtcttagaaaaca<br>ttactgctgacataactctgccgaaggtgtggagctctgtcattcgttggtgcattggacacacctcatgtgaaaactgtacttgg<br>gctattttcaatgacactgcttatcgtggaggttccacctttcattcgtggtgacaactcatgtgaaaactgtaccttgg |
| Contig40_<br>gene_930 | 802 | Atgagaaataaaagatttcatttcacttttacttaatgattgattatccgcttgctcagtttcagcaaatgatctgataatcttgaagt<br>tgatgatgaaatgttgtatctactagagatactcatgataaatcatgtgccatgagtagtctgtgtgtaagagttgccctgaatgtagattcga<br>cacaatctaataacttacagagatttcatgaagctaatgaataataacaataatgaatttaagcattgatttgaatcgattacaaatgaa<br>atcagttctgatcatgaagtttcatatcaggctgatattcatcaggacaaagagattcctattcatcttcagtgaaactcgcgatgatcctttgatatgta<br>ttccatgcttaaagcggacggcgatcagattttatttactctcagatgcagcaacaagcacacctattgttgtgaggacctgtgttatgaggatttatagatattaacaaac<br>tgaattccgcctttatttactccagatgctgatatctgtgacattgcagcatcatcatcatatggacatcaatgcattcagatgtttaacaagatttcagattatgcatt |

FIG. 7B-54

| | | |
|---|---|---|
| Contig40_gene_964 | 803 | tttatattggcctttacaggagaaacataactatagatggattgaagtttactgattcacaatacggctctttaatgaggatgggtataca<br>aataccatacagtattgagattcattaattccactaatgtttggttgaaaactgtgtatttgacaatgacggataccttatcaatgcaactgat<br>tcaagtgatgttgttattaaaaattgtaaltgttlccaatagtaatcgttcaaatgtattttaatgtttgaattccagcttactgttcaggattc<br>aaatttatccaagattagagatagctatattaccaattcaagttttaagctaatcaacaacaccatctgtaaca |
| Contig40_gene_975 | 804 | atgagtattaaacgaatattacttacgagtttaatgctatttataataataatttcaattcgtttgtaagtgcaaatgaaaatgtaacaaatga<br>cgtaagtacgaatgaactatcaacacaaactgtatcaaacgatataactactagtgaaagtataagcgataagcgatactagtctagactctgagaaaaacc<br>gggtttgatgagatcaaatgaattcgacagaagagtcatcatcatgcaagcaaataaactagtcttgacattaatgatctgacattaatgatgagagtacagcccaaga<br>agtgatgattgtttaactaaaaatgaaaaagaagcaacattgcaagcaaataaactagtcttgacattaatgatctgaagagtacagcccaaga<br>tgtactgacgcaatcgtacgaatttccagtcaagggggaggtacactctatctgaatgtgaacctatactgaaggaggccatgcagagttt<br>ataataatgacactgtatagtttccgtatatcgtaggaacgatagtacttcgtgatagtacttcattgcctttagcggttacggtgttgtggatgtaatgaactagata<br>ccaaatcaatatgctacatttcaaccaatactcgtgatagtacttcattgcctttagcggttacggtgttggatgtaatgaactagata<br>ttacccgattccggttttaattaactaacgttacttttgaaaattaaactgtacaggtagatctttagttttaacagcggtatttgacag<br>attgtgtttttaataatctggagtcctatcagcaccctctctcgtaactgagctacaatgatgtggtaagccaatagtactaactaattgt<br>aacttcaccaattccaaacaaactacaggggtgacggccctgctactcacggggtgtgtctttttgtcttcagacgaatgataa<br>gtatgatgtaactctcatcaatacaagcactgtgactctttttgtcttcagacgaatgataa |
| Contig40_gene_976 | 805 | atgataagtaggaattataggagcaggtagtctaggtacagcttagctcaaacagtgctaataatgtagtagtatatctgcacttaag<br>aagagaatagctaaaacaataaattcaactggatataacagcgaatactatccaaacactaaatataaaacaatatcatagccactactg<br>acatgaacgactttgattgattgacaacagcaaaagtattgaatatctccctcattgaaatcaatggtcgcttgatagaagaatacttgatgaaaactt<br>gaagatacaatactgtgacaacagcaaaagtattgaatatctccctcattgaaatcaatggtcgcttgatagaagaatacttgatgaaaactt<br>cgtagcccttgtcaggcctaattttgcatctgaaatttgtcttgaacctgcaaccgtatcaaacattgcttcaagaagcagtgaaaatgccataa<br>aggtcaagaaagtcctatctgtgaaggaatgaacataaacaaggtaaaatcattgatgatgttgtagccttgacaaagggctttgaagatctggtaggattat<br>gcaatagcaaacgtatctgtgaaggaatgaacatcacagcaagcagaatactgtggattcggagaccttgtctaacctcaagtgaaagcagaaccaca<br>agaagcatttgtgaaaatatccacagcaagcagaatactgtggattcggagaccttgtctaacctcaagtgaaagcagaaccaca<br>ccctttgaatgctctatgccaaagaatcatcgtagatgaaaagcaagcggtatagtaatgttaacagaattccgcctaaaatagctttaaagacct<br>atgaacaatatgaggagtga |
| | | atgatgagtgaagattcaattttgcttactataaaatctttacagatttacaaactgaaataaacaataactgaaatgcggaatattaatctt<br>agaaggatattacagtataacagtataagacagtaattttacagaaagtgtattagtaataaacataaccatttttgaaatggt<br>gtgtcattgatgaactatgaaggttagtattacaagttaatgcaaataatgcaaataaccgttaaaattttatgattttaaatttattaatggtcac<br>caaaatacttgaactatgaaggttagtattacaagttaatgcaaataatgcaaataaccgttaaaattttcattcttaacctccacaaatggttattgg<br>tagtgtatatagacaaaaacatcaagcaacatttaacagttacacattttaacaaacagttgcacagtctgaggttcattgtgaaattgtgtagctatcttcaataata<br>atattatgtattgaaaacattactttagtagctttgaaaaattgtcctttcagataacaacagtcttcaacagcacatgcagtaataattgatgaatgtcaaaagg<br>acaaacaattatacttactttgtcatttgaaaaacaggaacatctcaacatacaagtgaggagctatttgcaattatttgataatttaaaatgatataagcggtcatctaatgtaat<br>ttgtttcaataaaataacttgtcatttgaaaaacaggaacatctcaacatacaagtgaggagctatttgcaattatttgataatttaaaatgatataagcggtcatctaatgtaat<br>atattaaatactttcatttgaaaaacaggaacatctcaacatacaagtgaggagctatttgcaattatttgataatttaaaatgatataagcggtcatctaatgtaat<br>attcaataataataatactgcaactagtatatggaggagcataagaaatatcaaggaacagcagcagctaccgcatatctat |

FIG. 7B-55

| | | |
|---|---|---|
| Contig40_gene_982 | 806 | ttgatctgtagcatacaggcctgctcggcctcatgcactgcagtctatgtaggcctgatgtcagtgcagacggttcaacaatcattgcaagatg<br>caacgaccatcaggagtttggggaaacaacttacacagtgaccccaaggtagagaacaagtcaagccgtcttatgctgtatgcgaagatgaa<br>gcgtaaaaacagagcttccggcaacaacttacaacacacaccatatgaacagcacaaagcatga |
| Contig40_gene_996 | 807 | atgaaaatatcaagaattatactatattcctatattgcttttgtttatttttgttcagctcattcagtcatatacatagtaaatgctgaagt<br>tccaaaccctcaggaattatgggatatgcaggtaaacactgttagttcattcttcagccctgaaaatgtaggcgattgcttattaagatccag<br>ataacattaacgttacaaataaatatgatctgccacagaactgctgactgtaactgtagcataaatgctaactctgcagagtgatgcaatcact<br>acaagtgcagatactgattataagattgtagcttcagttcagttagaacgtaagctattcggttcatcttaagcggattgacactatcaatattgaatcca<br>cggacagcctgattataagattgtagcttcagttcaaattaagacataaatgctattcagagcggcgctttcaaagcatcttcttcatctgg<br>tattaaggtatatgactcaaatgataatgcttatatctcttcagattcatccagtgcagttcatcagcagcgagcatcttcttcatctgg<br>tcctatagtgagtccagttcagttatgatagcggtgctttcttcagttctgttcttcttgttcctgttcttcttcttgttttctgttgaagtgagtttgtaatctat<br>taagtcctatattttcattttattaa |
| Contig40_gene_100_8 | 808 | atgatttaatttcactattcctatttcattactcgctatcggtgcgcaagcgcatctgaagacataactgataactgaagcaatgaagcacctgc<br>tgctgatgaagtagtaacagttgatagtgaaatccaagaaacagttgataatccttgaagaatagaaaccgatacaagcgataacataatattg<br>aagaggtggaagctgctgacgatgaagctcaaatgcataaatgaaaaaatccagaactgttgcaaacctttgcttgcttagcatcattaacagaaactctaacagacatctggagagaaag<br>gaagaaaagttcaaattgcaaactcttaagtgagacaactcttaaactcttaagtggagacaactcttaagtggagacaactcttaaacctcaactga<br>ctcaagccttaattgagcaagatagcttcaccctttaagctgagacagctaacgtagagacaactgacagacagctaacagacctaactggagga<br>gcgaactcttaagtggagatagcttcacccttaactggaccagctagctgacagacagctaacgtagagacaactgacagactcacttggagga<br>gaagcacaacctattaggtagagacagcctaacgtagacaactggagagacaactgacagacctaacagacctaacgcctaactggagga<br>gacagacctattaggtagagacagcctaacgtagacaactggagagacaactgacagacctaacagcctaacagacctaactcttaacg<br>gagacagcttaacctcaactgacagacagcttaggagtagacagacctattaacactcaatatgtcaagcctttaggtgcgaaagcacaaccatcaac<br>tggacagaactgttaggtgacaattaacatcaatagtgagataacttaacagcaatctttgagataacttaacagcaagccttaatatgacaagccttaacatatgacaagagaaga<br>tttcaaacttaacctaacaaacatctttgagataacttaacagcaatctttgagaaacttaacaacaaac |
| Contig40_gene_102_1 | 809 | atgaaattatataaaatagcataatcattattttattattcattttatcgattggagcagctgcagctgtagaaaatgattattctaatgc<br>cgatttagatattttctaatgtcttctaatgtttttaagtgataattctaatgaaatttctaatgatcatttctctggctcttagatgattcttctagtgcct<br>tagtttcagaaggttcttctaatggattggattcatatagtggattcatatttgttttaaatgattttggttttaaatgattcttctagatcatctgtgattgaa<br>gactcttgtttcatattgactcaactactattgaagataaggccttaacttagaataacgacttaacatcaatgaaacggccatattatgcttctgaaggcacaaagacatatac<br>agacctgctaaaggatataaagagtgctaagaatgtgcttaacttcaatcaatgaaacggccatattatgcttctgaaggcacaaagtcttaaaaaag<br>gaatcgtattaacctttgatgaagactatgagcttacaatcaatgaaacggccatattatagatgaaatgaattgctgtggatttaactttt<br>gaaaatgtgaattgtcataaataaccttagcttcaaacttcaaacttaagatatcctctaatcttaactcttaactagcttgattcactacaaattatgt<br>cactttttcaaacaattatgcaagagctctgtgcatgcgaatgcagtcagtgtaatgactgttatgatgcttatgatggctgaacaccgtatctaacaattttatagataact<br>atgcgcttcaggatcagccatctatgcgaatgcagtcagtgtaatataagaagactgttttgttagaaacaccgtatccaattactactcactcaactgtcagtgtcctttt<br>atctatgatggatgagactgaaatatatagaagactgttttgttagaaacaccgtatccaattactactcactcaactgcagtatatgcgattatat<br>aatagaaatctccaactctcatttactactcctattctaatcttactactcctattctcacagaggagccattggagtaaggaatg |

FIG. 7B-56

| | | |
|---|---|---|
| Contig40_gene_102_5 | 810 | ttggcagtgatttgataatcctattttcacttgaactgttgcagcaagtgaaatatagttattgatgagtcttctgattcaatttagttat<br>agaccatgctaaggataattatttattcaagaagcagcctataaaagataatattttatctagcagttctcttagtgatattatttatctaaaggtg<br>ttcttgatgattcttatttatcagaagcgatttgatgattcttaattgatgaaaacagcttgatgatggcaaaggctctatcgatttgacgaatcataat<br>caactatctaattcagatgataaacagcttaaaacttcaattagaggatgaaaaacagcttgaagtgtaaataaggagataagcttcttaa<br>agattcaaatgacaatgtcgattgtttattaatatgatgtaaagacatcattgacccaacaagcatttatctgacagttcgcaggaagcgaagttccat<br>ggattataactgtttcctctcaatgaaccagctataataacagttggactgttggtgactcttctaaaaatgcaagcttgacaatattgacaagattgaa<br>acaatgggaacattcgatccgatccggaaaatggaatttggactgttggtgaatcttctaaaaatgcaagcttgacaatattgacaagattgaa<br>aagagatggtacatatataaacaaggcttatgctactacagagacaagtgatgaagagaggaattcagcataatgttcattatgctagtatggttgatacggac<br>gttcatcaaagatcacttctaacattacagagacaagtgatgaagagaggaattcagcataatgttcattatgctagtatggttgatacggac<br>tttatatatagatataggaagaggactcttcagaagacgatgcgcaatgaagaaggccaatctgaaggaaattcccatccaagactagatcttt<br>aggaaataaattgaaattattcaatgctcagatatagattatcattctcttccaaaacatcgtggagcat |
| Contig40_gene_102_6 | 811 | atggttctagtgattgaaccatttctgcagttagtgcaaatgaatgcgctaacgatggagataagtgatgataatagctattga<br>tagttctctgcttagaagggatgatttagttagctattgatagttcttctcagattttaagtaatgaaaataataaattctatgatgatagtg<br>taattaattctaattctcattaattctgattccttcattaattctgattaaccctaatcctaatattgatgataata<br>aataaccataaagatagcttttaaagctacaggcctcaaaaccgaacattacaggagctcaaatatgattaaacagataaacaagcaaagg<br>ctcaacaatctatctgataagatagttacctctataatgactttaagagaaatcaaatcgattcgattcaaacgttgtctttaagaacataataattagaaaggc<br>aaggccatgtcattgacggttaaagaaatcaaatctgattcttcatcaatgatgctcaaacgttgtctttaagaacataataattagaaaggc<br>gacgggacgagaatggagctataaatcttcactgtatctttgtaaattgacgacatctgacggaggcgtatttataactttatagtgattattcttacttt<br>tgtattttatccgcacgattctcaactgtatctttttgaaatgacgcatctgacggaggccgtatttataacttatagtgattattcttacttt<br>gtgattattctcgcttcagagggcaatagcgtagattatacaggagtgcctttattggattattccgataattcctctttcattgctatt<br>ttcaacttgtactttcagagggctaaggatggcggtgccttttatttaggcgattgccataattcctctttcattaactgta<br>tgacacttccagcgctaaggatggcggtgccttttatttaggcgattgccataattcctctttcattaactgta |
| Contig40_gene_102_9 | 812 | atgagaaacctaaagattatattatgaagactgattatttgattcttctatagttctatagtttcacctatagcagctgc<br>agatagcttgatttgatattccagagactgatcatatagagaatgcaagcgatgatttcgtactattgagaatgaagaactttagcattt<br>caattccattatgacacattccacacagacaggagaactgatgaaagctcttgaaaggcacaggtgctatgcaggttgcttagaaatggtgtcaattat<br>accaaggggatttttatatagagagaagccttatatcaggagttccaaatgatgagttcctatagatgcattttgaaatgggtaagtcagttgt<br>gattgattataaggacctttagtatggattgattgaataataagtcctatagatgcattttgaaatgtagtttaagtgggtaagttattaa |
| Contig40_gene_103_6 | 813 | atgaataataaaagatatttgtggccggatagccatattggctattgttctaatggatcagttgttctgcagttgatatgggcattcttagcgg<br>aagcccaaccaaattcagcattgacgcattgacggttacccaagacaataagccatcgactcaatattccacaggatatgcagttactgacaactataacagagtgaatgatacagaca<br>ctgctgaaagctcaagctatagggttaccccaagcaacctttgaaaaacaatgtacatgatgccattcagttcttgtagctgattgatcatgac<br>atgagtgaagatcatatctcaaagaggcaataagacaactataaatggtgtgacggatatgcaacccaaggggattactactacattcaa<br>ttatctttgttgatgggatccttgtgacatcactcttacaaatgcagatttgcttgaggattattattgttggtaatcagacagatgactga |
| Contig40_gene_103_7 | 814 | atgtccgagatattggaatcaatgacaatgacaataatggtgcttttgatagcagacgttaactttgctgatgacaataataatgcttaaaggctgaatc<br>caactctgctagtcagaatgacgcttcaatgatgaatctgctaatccacctcaagatcttgtagatacagatcttgatgattaaaccaatccatca<br>ctaaaagccactaaaatctaacatactgcctcactgttacaaacaattgataacagctctaacaatcagtgttgttgaaaactccctgatgattgat<br>ggagacatatctactactacaatcaacataacaataacagagaaagcaatatcagaagaagcaataagcataacatatcaaaagcattaacgacattt<br>atggaatatatttggttgctgatgacaataatcaaattgacaatcaaattgaaaaatgaaatgagagaacaatggagaagctgaacatagca<br>tcctctctcaagatactcctaatgtacgttgctgaaaataaaacaggcacttacattaacacaataatcaatgtaagctccaacctaacaagctcaagatcaagagttctta |

FIG. 7B-57

| | | |
|---|---|---|
| Contig40_gene_103_8 | 815 | tccgaagaagtgactgtttatgctccaatttaacaattacaaagtgccaatgatcaatcgttaccattggagaatagcaaacttacaat caacgttaccaataacgaaataggccattaagtaatttgcgtatctatgaagatcctgaagatcattattcctaaatgagttcactaacataa gtggaaattggactcttttgcaaatcgtgtggagattacgttttagcttgaccagctggatataggtgaatctgctgctataatagtatct tttttaacaacagaaattgaaattttcaccaataatttctatagcaactatccgaatcctcaagtagaggcaaatgccactgtcacagttgttcc aagaattgaaaagactgtcaatgccactgaaattgatatggagagtctgttgaatacaatgtttacatcgaca |
| Contig40_gene_103_8 | | atggactttaataatttcaaatatcttgatgaattgattcatagtggtgcaaaggaaataaatctagactcagactcagataatcctagagacaaaga agagcaaaaatattcagatgaattaaactacagcaatgcaatagacatagacaatctagtcattaaggcatcatcaatgaaatgccatattaaggcaaataaccagaa tattctattccacagcccaaactcacaatcacaattagattaaaaaaacattagttaaaaactcaaatatgcggatccatatacaatattagagaagagcatatacaacctaaag ggcaaaatacatagagcccacaatcaaaagaaaaccaatcaaaataatgcggatccatatacaatagacgaaggaagagaatgaaatgaaataataaa gtccacattcacaaaaacaatgcaaattcacaatcaaatgagggcaatccacaactatcaaaggcaagatgagcatagaagaataaataaa acaccgcaaagcaaggagagcaatccacaatatagagcattcaagcaatagaaaacaccatcaagccaagagaggcaatatacaatatat ggagccatattcaactgatgcaatgagttaaaatcaccgaaagtaaaatcacaataaaacatagaaaatagtgagcaatccacagctgaacaatttcatcaaagactccataatcaccgaaaac ccacactcataaaacatatcatatgatgtgcggcgcaatacataaaaatacaaaattacgacttccaccatcgaaaacaatgatctgacatatccatga atatcaaacaaagtggagaatatttctcaaacataaaataaataacaaaattacgacttccaccatcgaaaacaatgatctgacatatccatga aatagactcattttagacatgattga |
| Contig40_gene_103_9 | 816 | atgagcaaagtttttagagactttgaattattgaattattgatagaaaattgcgacgatgagatagttttggattcagacatgttttaggagatgtgaagg ccctagttactaggaagcattaatttgatagttgatagtgataatttattgatggaatgacattcaatgatgcatgtgggaaagtgagaatattttt attctcaggagaactacacttaaaaacattagcttatgatactctgataaagcggagtggccatagtgtatgatggggaagatg gacataattgattctatcatctctgaaactatctgctgatgatgaggcgctatacacaatagaggaaggtgaattggcctttataactccac agtaaagagaacaagaagaattcgtggagcaatcaaaattagaaataagcaatcttttaagacaacaaagcatgtgaaactgtaaactgtgaaatagctcaaatgaggcac gttttggtgggcaatcctaataatgatcagaagacaagcatctgctgatgcgggagtattctataataatgtaatggttcagcttagtgaaatcttctaattat aatcaagtggtaactcaaattaaatgacaatcaggcagataatatgacgcagagtctagatgcattgatatttgatgatatagggcagaatgtgtgagctatctatagcga aaagttattgaatccaaatatgatgagatctattgtcaattatgacgagtagagcgttagatctagattgatgcatcgagtctagattgatgcatcgagtcaaaaactctgcggtgctatatat gcggggcatactcggatgtttctaattcagagtttaattcaaataaggctaaaaactctgcggtgctatattat aaagtgcatctggatgtttctaattcagagttaattcaaataagctaaaaactctgcggtgctatattat |
| Contig40_gene_104_2 | 817 | atgatttagagaggaattaaataaatcgatgatgaagaaatattaattaaatcaactgaaaacaaaataaagacaaaa agaagacaacaactaaagagaaactaaaaacgatcgataacaaatcgataacaacctaaaaccaactgataacaaatcccaaatgaaa ataaagaactccaagaactcaaaaatgcagcagccataaactgacgaagaaactgatgaaagaacgaatgcaaaacgaacctaaagaaccatctaaaaagattt aagaactaaacacacaactgacagacattctctatatcagtgaagaccctgtctggagagaacaataacaatcaccgattggaa agagatagaagaacaaagacattctctatatcagtgaagaccctgtctggagagaacatatcaacaatatagagacctgaaggaatgc gcctttatcatagccaaggattacaagcaaagtccaatttatcgaatcaatgttccagcttgcagatgctccagcttgacacatttgcagactttgacgacttgaa acatggacactcccaatctcttattagcttcaatgactgttacccgcctaaatgactattggagatgtctaaatgactgttggagatgcgcgtctaggtatctgatgtctc taacgtcaatgacatgacccgcctattcaatgactgttaccgcctaaatgactgttaccgcctaaatgactgttaccgcctaaatgactattggagatgtctaaatgactgttggagatgcgcgtaatcttacaaga tgtgagcatgtttgcaggctgcaaatcattaaggacctagaacaaacacatgtaagaaccaatgttacaaacatgaccagtcttctttt acagaatgcaatcattgatgatataaagtgacgacagctcagatcatggacagcagcctaatctaaaagaataaaagattagaaaaaatggaagtctcctttgggatgcaaatc cttaactgacattttcagcttcacagccttaagcaattgaacaacaaagcaatgttagaaaatgggcgcatgtttttgaact |

FIG. 7B-58

| | | |
|---|---|---|
| Contig40_gene_104 | 818 | atggcagaaatgaccataagaaactccattatagaaaataacagtgcaaggaatgaggggcatcctcaatgatgaaatcttttattgaaaa<br>gacgactttaagaataatcttgcattactgccggagatgcgaaggcaataagcaatgaggatatgttcattcctaaaggatgttcaatgaaataacattg<br>cagttacaggggctgcctcatcaatggagcagtcggtaattcagataatcttttgctgaaaaacacttccttcattaataactcatcaccttttggaag<br>aacggcaacatgatgtcggcggagcagtcggtaattcagataatcttttgctgaaaaacacttccttcattaataactcatcaccttttggaag<br>tgcaatatacaattaggcattgatattccaaaattaaaatattttatgtaaaataaataaataaagaagactgcaggactgcaaaacaatagctcccata<br>taagcggtgagattcataatgagataggtgaaatatcaatagatgattcaaaaaagatagttcataatttcaatctcatgacaatccacgctctaatttcga<br>gacagttatctgacaatcacatcctgtgattttgaaatgtgggaaattgaatcttaagcattgaaaacaatcactctaaaagaaaatcgccaatatcagcgatt<br>gtcaaatcaatcagacagcgcagttattgaaagatggggaaattgaatcttaagcattgaaaacaatcactctaaaagaaaatcgccaatatcagcgatt<br>ataccactgtctataatcatgaaaagattgcaacattacaggaactatttttgaaacaatcactctaaaagaaaatcgccatatcagcgatt<br>aatagtccaatatggtcttaaaagaaatatcagataagaactgcagcatttttcagaatgtcagcaagaatcctaactgccgagaaaaatataa<br>aaacttttcgttctcgtagcaggcaagttttatctttgatgatgttttaatttagctatttgatg |
| Contig40_gene_105 | 819 | atggatttatagataaattaaaaaagaatagcagaaaagaatccaaagctctaaaagaatacccaaaggacactgattgaagag<br>gaaatctccacctattgacaaggcatcttttgatgtgagcgatgatgtatacaaatttatttgaaagcataatgtcctataggacgagccagtcg<br>tccatagtatcttaagaaaaataagtgacgatgcgcctattgagctcttgactcttaggactcttgactgacgcaatccta<br>aagataaaacatgcctcaagagaagactgtgattgagctctttgacctaccggagagagatatcgattcaatgagaaataaagacctaaaatgcaattgcaatcgcaagcaa<br>gtccacaagagcaactaatgagaagctctcattgatatcgtatgcctacaaggtatgaaagcatacgagacaagttgtgaaagattaaaaacgat<br>acaagtagtgatgagaagatgcctgaatccagcagaagcccttaagctcaaagtgcctaagctcaaatgagatgcctaaaatgagctgaaggatgaccatatacagctga<br>ccagaagtgatgagaagatgcctgaatccagcagaagcccttaagctcaaatgagatgcctaaatgagatgaggatgagatgcctaaatacagctga<br>atacatcctataaaaggaaatactacttttgagattttgagattggaataacattaaaaaaaatactgtgaatatattgcctgaatattatacaatctg<br>tcgcccataaaggaagatactacttttgagattggaatggccctgaatggccctgatagaatcaatgacgatagcctttagtgacctgatgcataatgagactgatga<br>gatgcttcgcaggcttgctgcaaatacattaaaaagcgaagaagcgttaaaggagtcgtcaatgacactaatg |
| Contig40_gene_107 | 820 | gtgccttaaggtttgcagtagctattcaaatgagttcacttcaaaaagttccaactggaagaaatcaagacgagctgatggagaatcaaaat<br>ccaaaactatacaatctcttgacatatttgtaaacgacaaaaagttcaaccaaaaagttccaactggaagaaatcaagacgagctgatgcaagaatcaagaagaatcaagaagaatcaagaagaattcaagaagaattagacaaataagttcaggaagaaatcaagacgagctgatacatagtttaaataattac<br>actccttgacatatttgtaaacgacaaaaagttcaaccaaaaagttccttcaagagcaattcagttccttatcagcagcgatatgcagatttagcaatatgcagatttagacacaatagtttaaataattac<br>atcccttgtaagcgctgatgaagcactgtgacgactttgctccttaaataagactgctgtctttaaagtatacacactcaatgacactacaa<br>aattagcagacgccaatgactgattatttgaatatgcgaagattccatttcagcgtcaacagagaataataaagataagcgaagctccagg<br>ggaggaagtcacttcaccatacaagcagctacaataataatcaaagctatgaaaaccaataataacttgaagtgaaagtaaaaacaagttgaagcacaagatcctatatc<br>aacataacaagataacaacagcactacaataatcaaagctgatgcagtctataatgtacaaatgctacaggctgtacggcctgaacacaaagatgcaaacgatatc<br>agaacatgagcacagtggctgtcaaataggattcaatgcaggtcgatggcagctctaataatatgcaggctcatttgaagcttgcaatca<br>aataacatgccagtgcaaatggattcaatgcaggtcgatgcaggtcgatggcagctctataatgtacaaatgctacaggctgtaaaactaaccgacgatgaagaatctccagagatcagcgaagttta<br>tgaaggctcatacacctttgcaatagcattcttgggagacaatattcttgggagacaatattcaggctcatttgaagttgcaatca |
| Contig40_gene_107 | 821 | atggagaaactatgaaatctaaactttttatacttctaatcattctaatagcattcatcagttcagcaagtgaactccaagc<br>tgatgcatcaaaatatagataatgattatcaaacaacatgaatttgatcctatctgcatgataaatcaaaccaggatttaaatctga<br>aaaacaataatgaacatatttttaaaagaagagaacacaaacccccagaaataagaaatgaaacatgcttaacatgtttacaactttatatcaggaaatcaat<br>caatcagatgatgagctaacctcacacatgactactatattattcaataaaagctatgacaatgccagcttatacccaatgtattacgccattaat<br>ttcagtgaataagaccaattttacaatcaatgaatgccatatcatcgacgagtgccatatcatcgacgagtgaaatgggcagaatttgattttgaaaacataagg |

FIG. 7B-59

| | | |
|---|---|---|
| | | gagaaattgtaattaatgacttgacatttaagaatttcaaccaaacagtttacaaattacacgaaagcttacattaaacaatgtcaactttaca<br>gagagctttgaatcacttgaaagcattatattgtaagcaagcgtcttgaatgtaaataattgcagttttattcaaaccgcaagaaatat<br>cataagcggatcccagtcaaatataaccgtaaaacattcaatctttctgagaatggcaattatgaaagagcaattcagcaacagatgcagc<br>tggtcatccacaattccagattgaaatttcacttcaagaacgtgcaataactactttcaaggatattacctagatctagaaaactcaagt<br>ttcaataatacattccaatttaagtgcggagcaatacttgaaaaatacttccccgctatataaaagtagctaataaaccaatacttcc<br>atcagacctatgataatcaaaaactgcagatttgaaaacattcctgcctcaacgacggggagcaattcact |
| Contig40_<br>gene_108<br>4 | 822 | atgataaaaagattttatagtttagcttttattctgctagctatttcacaataggggctgttggcgcttctgatgtatcagagctgacagcaaa<br>tgattagtagatgataatgctttatctctaaatgatgtgaagattgctgagatgaatctgtgaatctgcaagaatctatttaata<br>atgataataactatattatgaaaataggtaaatgcgaataatcttgattagtgctggtgataatgatgcatctaaagacaagtcctatct<br>gataatgtttccgatctatatctattagtcactccctagcgtctgtcgatgacactcccaaagcaagtatcctaccgccatgctcagcttaaa<br>tgattgagtggcaatcctgttgctgaagcagcgttcgtttcgtagctcagtgcgatgatttcggcagagtattccggcatgcactgtaatcaccaacagatgtacat<br>gcctcttcacttgataactatctgtctgtaggcagtcataaggttgggcagagtatttccggcgatgggacttatgacttcaagcgcttcc<br>accaattcaatgtattggaagatattctctcttatctaaatacagattgttcatatacagcactgcaggaaggggctatactctgt<br>tacaggtaagctgactcatataaatcagcctatatcaataaagcgtaggcgtcatgagcttaggaagaatatgtaggtgatcgaggatttgaacctca<br>agcaaggcgaaatctgagggatgttattcaatgtcttgcctaagacaatatgaggcctatggagatgctacaattccatcagcgttg<br>aatgccaccaaatacttcaatgtcttattgaaagacaatatgaggccctatgactacaattccatcagcgttg |
| Contig40_<br>gene_108<br>8 | 823 | atgatgaaaatgactaaaaagaatctttttaattagttaatactactatctcttacaattggtgctgtcagcgcagctgatgatttatc<br>tgcatcatcagatctgacagttgaagattctgaagagttgaagaagccatagctacgtcctgaagaatctgttctgattaataatgagattcga<br>ttgctagaagggcttagtgatcctatctcaaatgaaactgcgaatatgcgaatatcgcaatagatgaaaagactacaaatgataaagctattctgaagag<br>gataattccatttattctaaagacaaggctaatgttcctcgtgaaaacacctgtatttgtatttgactataaatgctcaaatatctattatgg<br>tgaaaccgctaatgtaactgtttctgcaagtgtatgggcgtcaaggaatatatctgctacaaaaaaatatcttgctcttgatgcgcgtgtgaaa<br>atattttaattttgatgacggtattgtctcaaaagaaattatacgttgaagttaccccgacagttcaataataatcatgctgttagctgacgtaatagagcaaataatatatgggaaag<br>ccttatcctcctgcaagtgcttcatgtaacctatggaaaccagcttattccaattggcttgactcattctccaaaaaagaaactcagtggctgtccaatcctcagcttagcgtgtccaatcctcagcttagtgtccttat<br>agcttatgtcactcttcatgtgcaataatattcaagtgacttattgtttcaaaaaagaaactcagtggcttgactcattctccaaaaaagaaactcagtggctgtccaatcctcagcttagcgtgtccaatcctcagcttagtgtccttat<br>tcgtagaggatgatgcaagcgcttcactcctagcgtaatttcaaagcgattttatgttatgctaattcctattccatttatgttgatg |
| Contig40_<br>gene_108<br>9 | 824 | atgtgattatgaataatgaaaagctttttattgttagtttgattatactaacttatttgacaataggcgctgtcagtgcagctgatgatgcct<br>ggccacatcagatgagataacagtggatggatgattcgtcagtagccgttctacgcttctgcagagtcagatatttatgaaactaatgagatatag<br>ttgctgactatcaaagtgattctatctcaaatgtaactgtggatgatgatgatgatgaataactgtaaaagatgagataatacgctcttctcctgctaaggacaat<br>ctcttcttgatgatgatgacgtaaccgatcggttgctgtaaatgatgatgatgttccatatgttcccatttcaatcatcacatgcttgaaggatgcattgaagagatatt<br>cacaaatgaatatgacgtaaccgatcaggatgatgagagctgcgaatattcttagtcgttttctatgttagcgatctggtgactgctgaacctcttatcgataatgatgagga<br>ttgtcgttgtcttgatgacgatatacagaagctgcgaattattgtgggattgtattgcaagagattattacactcacctctgtgctgaacctcttatcgatctatgatgagga<br>agatgatacaatagattttgatggattatctacaccgtttactgccctcaggaaggacacagtcaccttaactctaaggatgaggaggatagagacattt<br>ttgacactagtgctatctataccgtttactgccctcaggaaggacacagtcaccttaactctaaggatgaggaggatagagacattt<br>ttacccaggaaattgaagatgctgatgatgaatgaaatcaattattagatttggattagattattagcaattggtgaccactatagatgccggcaacta |

FIG. 7B-60

| | | |
|---|---|---|
| | | tgaggtaacaatcactcttgaaatggcactctcattgtgaggatgataagaattatgatcctatagaa |
| Contig40_gene_109_3 | 825 | atgaagtttaataaaataggggcatatctgccatatcaataattttaattctatttttaagtatttctatgcatctgctatagaaataagtgc<br>agatgatgctgatatggattctggagacttatccgtttgtgaagtcagcacatctgattgctacggcgagactcgatcagcgctgatgcatccg<br>gtgctgattcaagtgatgaaattataatcaacgaaacaattgcagatgaaaagacagactatgcgcagctcaatccttgctgatggtgagaagaaa<br>aaccttcatgttgaagtctctaatgatgttttcacacctgataacgattgagttcatgtctctatgatgaggatttaatcaaatcggaggata<br>tttggatatatctcttaatgatgaactaacatactctgatttttaccgttgatagtagtgaaagttcttctattagcttaagtggtctagagtgcg<br>gattaaataagataactttcatatatgatgaagatgatgttatataatgccatcaaacaaaagaatttacattatgagaaaatcctgaa<br>tttgtcatgatacctcattacgatccataacattaaatgcaattattcttctagagtatatctgaaggaatatgatgaatgggatactatga<br>tgaggataatgagggcgatattgaacctatgtgaaccatttcgatgatgataaattcaatgtatacatcaaaaccactgaaactattgattagatgtcttaatgaagcttc<br>aagtgagttcgaagctatgctccatacaactcatctaacattataagatgtgccatcaaaacgatttatcattaatgatacctacttattccga<br>taagggtttcgattctcagtttatctggttgataatgccactgagacataatagataagaatttaagctta |
| Contig40_gene_109_6 | 826 | atggcaatgtatctgcctctgatattagtgcagatgattctgtatcttagatgcagcagatcagacatcgtaagcactgattctataagtgt<br>tgactctgtaaacacatattctgcagattcgacttaatctcttcaatgaagataaagacaattatcaccctccaatctaaagatgatgataata<br>agatttcaaaaatcaattatgacacgtctctttatggagatgatgtcataataacgcaaatcttacagatatgacgaaacata<br>atcgatgagttttttccaagttacagttatgatgttgaaggcaatccattgcagtcaatcagcttgaaggcaagggaccatgattgttcctacagt<br>ctcattgaccgagagcagttattatgatgttgccctaagtttgcaggcaatgagaatatgcttcctgcaatgaatttacaagcttaacgtga<br>ctttttaaggaaaattcatatcttgccatttctaattctaatgatgaatccaacttcatcatcttcatcatatatgtggat<br>gcgaatatatcaacgacacagctgacattaccttaccttaatgaagaatactattatacaagcgtcctttacaaatgaaatgaagtgaccattga<br>aaacctccaagtgggagagaaatactgtttagttaaataacggctctaatatataaggctcagaagactctgctaccataatgggatatg<br>aaaaggatacctccattggaatcggatgtccagatgtccttattgaaacgatgcacgataaagattaatctaactgatgaggacggcaatatt<br>gtaaatgcagagtgggatggtgaaattacaatccaaattgcgtgcaggcgttacatatttcataaggcgttacataaaggcgttgattatgaaggaa<br>ggcaataattgttattatcaatccaaattgcgtgcaggcgttacatatttcataaggcgttacataaaggcgttgattatgaaggaa |
| Contig40_gene_109_7 | 827 | gtgtttatttgaaattgaaattaaaagaagtttaatattcattcaatattagcaatattgatctttatctattggaatgcatctgcttctga<br>agaaatttctgattctgttttcaactgatatagcatctgaagatgttacaagcgaaattcaaacagattgttagaaattactaatctagatgaag<br>actcttcttagatgatgctgatttagaaaaggatacaggcgataaaggcaaagacgataaaatcaaaagcaagaattaatactaactactccaaaat<br>atgattaccaccgctgtagttatgatggatgcaggacgatggggaatacttagttagttgatgaagacgaacaagcctgtagttgg<br>cgaattgattcaaattgcaatgtcaacggtagttataatcgaccactgattcaaacgttgaggccaacttcaatcacccttgcttattcag<br>gtccttatacctttgctatctgctatttaggctgaagatacctatgaagatctttccttgaagttgtacccttaaggataataaggcaatttaaagtgctaagatgact<br>ttaactgtcttcctccaaaagctataacgtaaagaacatcgctaaaaccaaaacattaactgctaccttaaaggataataaggtaagtcatttaattaaaagcaa<br>acagatcagcttcactgtaaacgtaagacatacagtcaagatgccgattccaaaggtgtagctactgttaaagtaagccttccactaaaaga<br>cttacagcttcacagctttgctgagacaagtcatttgtgcggttactaagactgtaagttactattaaataa |

FIG. 7B-61

| | | |
|---|---|---|
| Contig40_gene_1098 | 828 | atgcaagcaattattccagttaaagacaatttttctaatttagtgacaaatatgaagaaaagtgattttaaacgtatattcatatgtttagttct<br>tcttacttgcttgattggtcagtaataagtacgtcgagcgagccagtccaatgatgttcaagcaacaacaagcctagcagttgacacaatcactgaag<br>atgcaagtgaccctacagatataagtacgtcgagcgagccagtccaatgatgttcaagcaacaacaagcctagcagttgacacaatcactgaag<br>accaagtctacaaatgtcttgaaagatgcacatccactaacatttatgtgcgactactgtagcagtgaaatgacgtttaactcaatctac<br>tgctgtagtcagtcttgcaaagcgtaaatcttatgtgtgaaataaatcttactacagatttactattaatgttgcaaacgtgactataatatta<br>gcaaaatcgaaagtcctgcagtcaagacaaactcttatggtgaaagcaagagcgatcttcaatagtactaccagtcaagttctgatcatatgtatcaac<br>gtttacgaagataacattgcatgactattggactattgaaaacttgactatctgtgatttcaataatcgttctaaaaacggtgctattacactaactcttcactgaacaagacaa<br>tatagacagtgttttcaatataacaactgttcggtcctactattcaagtcactcccatatttaagtctgttatctatgccgaccaagctcaaccaatgttac<br>tctccaatgttcttatagaagactgtttcggtcctactattcaagtcatctccatattttaagtctgttatctatgccgaccaagctcaaccaatgttac<br>attgaaatacgcgttcctatatgttgacaatatcggtgctatggttcattggtgaagctaaaggagcatttaaag<br>tttaaagaattccgaattgttgacaatatcggtgctatggttcattggtgaagctaaaggagcatttaaag |
| Contig40_gene_1099 | 829 | atgaactttaaaaaactttaatgatttcattaattctattattgtcttatcagtaggattagcacagcaagcgctatagactctgataatct<br>attagatgaaaataataatttaatgttaatttatattgattctgataattctatttaattctattttaattctaattgtgatcttcaatcaatgaa<br>ataatttaatattaatctatacaaaaatatacaaaaatgaaaaaatgcaggtcttaaagacaatacaaatcaatctagagtgtgattcttcaatcaatgaa<br>aattagattagaaaataattacaaaataatgaaaaatctgcaggtcttaaagacaatacaaatacaatactatacgtatctgtagacggaaatga<br>tgaaaatgatggttgactctagaacagcagttgcaaacatatcaaaagctgtctcacttgctggagaggatgaacaataattaaaagaataggcacagcaaat<br>gtacttatgaacaaaacagtccacacactaaaagacaataagcttacatttaacttactactatattttcttcaaccactccaatcaatccaatattaag<br>gcctttacactacactcagacactcagaacaatagacaatacactgtacattacatcgtacattattgcctaaaatcgcttatcagtaatatgatcaattaagatcaatattaagttggatcaagta<br>catgctgaggcgccgatttgcaaatagaacaactgtacattgacacgctctacaagcgcttcatccagctgatgtcaatacaatatcactgttagctatcgatattaaatgcatatttactcataagtaag<br>caggaaagattacaaacaccaattcaaatatcaattgaatgccggtcaaatttgcaaatagaacaactgtacattgacacgctctacaagcgcttcatccagctgatgtcaatacaatatcactgttagcggtcattgacagcgccaatcaatcaattaagtaag<br>gttgagaattgtacctttgcaaatataaccggcaatttgaatgctgttgttgttaataataagaggtatatgcagattaaaaatt<br>ctgtgttttaataataaccggcaatttgaatgctgttgttgttaataataagaggtatatgcagattaaaaatt |
| Contig40_gene_1100 | 830 | atgttctaatagtgcagcaagtgcagcagatgcgcagcagatgcgcagcagtgatgctgtactcttgaaggggatgctgcagctgtttgattcaattagtgaagatgctagcgc<br>tcctataactactacgttagtgaagatgctagcgcagatgcgcagcagtgatgctgtactcttgaaggggatgctgcagctgtttgattcaattagtgaagatgctagcgc<br>tggaactaaagtaactgacgttaaacaaaaggattcctctgatgcttaaacaaacgggaatccactactattttgtatccactggggt<br>aatgcaataatgacggcttaagttggaaactgctgttgccactgctgttgaaaaagcaatcaatataacaaacactggtgaactgatttcaccct<br>cttgatttcaaacgtgattataacattgaacaatcaccatcccgtcgcaaataatttctattatggtgaagcaagaggcacaattc<br>ttcatgctccggcgattatattgattgactttcacgattgcatcttgaaaaactcgactaaaacagcacttcctctacaagt<br>gctgccataaggattattatgtgatgttgacatttgacatttgacatttgaataatgcattttaaaaacatcagtgactcttccataatcatgttctggaaaag<br>ttccaatgaaaaacctccatttaggatattatggctggatccatgttaatataaactgcttgctaccaaatcagtgactcttccataatcatgttctggaaaag<br>gtccggttagtttgataatgttgaataaaggactggataatataaactgcttgctaccaaatcagtgactcttccataatcatgttctggaaaag<br>ttaagcagcgctgatccctgatccctgatccctgatccctgatccctgatccctgatccctgatccctgatccctgatccctgatccctgatccctgatccctgatccctgatccctgattttcataatcacatctaaaggaaaat<br>taaaattatcaactacaatttcgataactgcttaacgcttcatgcaagcatatttccagtggagtaa |
| Contig40_gene_1104 | 831 | atgaaaattaaaagagtttgtcattttatgcttaattatctttattttattcgcaagtgtcagctagtgataataatgatacaaccat<br>aagtgatgtgacaatctaatcaaagaggcagatgggacttattaagcctgaagtgataatctaaaagaattaaatgaagagtcagata<br>aaaatttactagtccaagaatctgataatgttactgatacaagatttactgttcaagaatctgataatgatataat<br>ctagaatctgatgagggcttattagtacaagaatctgatgatgatttaaataaaaagcagacggtagttgtttagctcaaaatacgagataa<br>cgctgctctataaaaattaacactagtactacctaataaagaaataacagctacctcgagaaagaacaactagcccaagcaataa |

FIG. 7B-62

| | | |
|---|---|---|
| | | acaactacctgaagaaagcaataacaatgccataaaagagaataagcaagtatatcttgaaaatagctataaagaaata<br>aacaactatctagaaggaaaacaatttcagcaccctaatcaaagaaattaacaactatctagaggaaaacaactaccttccatcgagatgaat<br>taaagctatcttcaatcaaacaattacagctctcttcaagtgtccttagcgatgtaataagcaagataataaattcatctaaaaagaatcag<br>agccaattgacgatgaacttttaccgctttacccgcttgcagtataaaatcaattctgcccaaatgcgctacaataagcctagataagattatagctat<br>gatgaaggattcagcacagagagcattgaaatcaagaaagcattacaatcaatgaaacgacacaccaatatagtattcgccatcaaggat<br>ctttctcattcatttgattgactgaacaataagtcacattaaacaatatagtattcgccaatgaaaga |
| Contig40_gene_110<br>6 | 832 | gtgactgtttcagttttataagtgcttcattgcttttgcttttgcaatgttctaagcaatgcagataacgatcgtgcaaacttacaatagtcataa<br>ggatatttcctctccaaatatgattatataagcatcctggtgaactcctattatgtggggctgtcgtggtgaaatcaaaatattcaaaccgatggcata<br>tttgcgagaaataa |
| Contig40_gene_115<br>8 | 833 | atgaaggtctaaagatagcaattatcatgcttatttaatcatatctctggagcggttcagcaacagagaatttaataatgatttaagtga<br>taatggactaaacgataacacattaagcgacaacagcttaagcgacaatacctttaagtgatcaaaagcttaagcgaaagca<br>caatcatccaaatgatcatgataattaaaatacaaacagctctaaaagatcctgcgaagacattacagactta<br>caaatgaaataataaatgcaagtgacctttagaattgacagacgactataaatgcaacaatatgacataatcaacaatgaaactgacaatatcacattacaatctctaa<br>aagcaatttcgtaattaacggaatggccatacaaagacaatgcgagacaatcaatgtggcattttccaaatcaacggaactaacataaccctaaaaa<br>atctcaatataataaatgcaaaagtaatatttgcatttgagcaaaatataacaagcaataatgataagtttatagactgcacatccctcaatgatgagt<br>gacagctcagacaacaaagagtaatatttgcatttgagcaaaatataacaagcaataatgataagtttatagactgcacatccctcaatgatgagt<br>aataaactcatacgtttaaacacaaacattgcaaatctctatcaacacggatatttgaaagctccaagccattgaactggctttcgtcaacagtttggaaatt<br>cctcaatctacgttttaaacacaaacattgcaaatctctatgcagagacaataggcaatatatccgaaagcaattgaaatcgagaaacagtaatcatgattct<br>aaattcattaatctctatgcaaacctactgcagagcaataggcaatatatccgaaagcaataggcaatgaagaggctacccaataatgatttt<br>gagttcacaaaaaaatggagggcaatattccttgacatattccagataggagctacccaataatgattt |
| Contig40_gene_117<br>6 | 834 | atgaattttaaaacaaaggaagcttgattcttatttcattttcatttttaatattggcatcgaagatataaa<br>tacagatagacacggattatcaatctgatagcattgatgtgtctgattgtaagtttaaatgataacagatagcatctgagatatgttgccta<br>actatgaaattgcaaataataaatccaaggacaaactatatgatgaaggaagaagaaggcgcataaacaaatgacgatgatgaaaattat<br>agaattgatgaatctatgacagtctgtttccgagactggtttattaatttttatgtgaaagtacagatgtcgacatatatcatccattgaagcaa<br>tacagatcaagactatgagctgtcgttccaatttatttgcctccaggagactatgtcatattctttatgaaggcgtgttttgtgatttttgttgga<br>ccggctcaccgactactgtcgttccaatttatttgcctccaggagactatgtcatattctttatgaaggcgtgttttgtgatttttgttgga<br>ataagaagtatgaagaactcaatctagatgtaacttttgaagatgcagaagagaagaaatccgaattctctatcagaaccaactacaa<br>caaaagtatatgcaataacaacaagtcaactctacaagttgaaaatctagaagatttacaggaaatatgaagaagcgataaactgcaaaataagcttaa<br>tggatgaattcaataacaacagtcaactctacaagttgaaaaccttaaccagaagtttacaggaagatctagaagatttacaggaaatatgaagaagcgataaactgcaaaataagcttaa<br>tggatgaattcaataacaacagtcaactctctttgaaaaacctcacagtcaaaagcaattaccaacgtggaaaggaatctagaagatgattcttaaaagttgtagag<br>ggccaaaataacaacagtcaactcactcttgaaaaacctcacagtcaaaagcaactatgaccagacaactaccaaatcatcctcaatccag<br>cataacaaaagtcaactcaactcacagtcaaaagcaactatgaccagacaactaccaaatcatcctcaatccag |
| Contig40_gene_119<br>8 | 835 | atgggaaaatttaaattctataatcttatttattctagtttagctctattttaatatgtctcctatttaatatgtgcctgatcttgatgg<br>ctctttaaatctttatacctgaggataattcctgattctagtgtaagtaaactcagatcgtgaagttcgtaagtcatgagtggggtctgttcagttg<br>acttaaacaaatctgaggataattcctctaaagaaactcagatgatgaaattcagatgattatgaagtatatgacgattctttgattgatga<br>ttgtatttctgcaatatcttaaggatgaccgaggcatgttaaggatgctaaacaacatcataagaatgtgatgatcattttgacggagcctgcatta<br>ctgcaatatcttaaggatgaccgaggcatgttaaggatgctaaacaacatcataagaatgtgatgatcattttgacggagcctgcatta<br>gccagagctttctcaaaaattgagatttatgaactccaacactgtaatattgtgaaatgaactgagttaggaagaatcgagggctat<br>gagtctccagagcaattcttaagtgaactgaaagagtataatggcaaataa |

FIG. 7B-63

| | | |
|---|---|---|
| Contig40_gene_121_5 | 836 | atggattctaagaaaatattaatgattgcttgtagtgcttgctgttgctgtgtaagttcatgctctgcaggtttcctgactttagg<br>aggagacaacgctactgacgacagttaattagctgcagcagcaagtctaaaaatgtatatgatgaattgattc<br>caatgtttgaagcaaaatatcctggagtaaaagtaactccaacttacgcttcaagtggtgacttacaaactcaaattgaaaacggttagaaaca<br>gacgtattcatgtctgcttccaacaaacaaatgaacgcttagctgatgaaggttaatcgacaatgacaccaaccttcaattcttagaaaataa<br>agttgttttaatcgtacctaagaagattcagacttaaacatcacatcagttagaaagatgtgaaagtaccattgctattggtgacccag<br>aatctgtacctgcaggacaatatgctaagaagcattaaccaacctcggtatttgggacgctgttgaatctaaattctcttaggaactgatgta<br>actgctgtattgaaccaagtagctcaaggatctgcttggtatttgtatatgctactgacgctaaatccaatgatgatgtaaaagtggttg<br>tgaagctcctgaaaactctttaaacacttcagttattctcgtagctatgattaaagacgctaaagatgcagatgcagcaaaagcattccttg<br>aattcttacaaacccaagagctaaagctaaagcttgttgaatacgagattaccattcacgaataa |
| Contig40_gene_123_8 | 837 | atgaagttaaaatcaaagtatttgtatttactcataatatgtatccatccattcagtattcaacagtttcagcgaatgataatgatagtat<br>aaatcaaaatctgcaaaatgatgcaaatcaagatataaatcaagattgcaatttaaatgacatatcaatcagatcaaatctaaaccaaaatt<br>tgcaggcaaaataatcaagaaatgattgtcaaagcatctgaagataagactcagaagacctatctctataatgacataaaaaactgcgaagatacg<br>ttcaatatagaaaacgactataaatacactgaaagcgataacacaccttatagatcataaaaccaatctagtgataacgaaataacca<br>tgtcattgatggatccaatgaaagctggagatttgaatttttaaagaatcactaaatgtcaatttcactacaccataaattggcatttgtatttgtattcagag<br>attacaccatagttaatgaagacgaggaaatatcagttaataatactataaatactgtaatttcgattacaaacaataatactaacctcatatacacaatttgcaga<br>ggaatgatatcagtttcaagttttaaccaacgaaaaggattgaagccctattgaagccctattgaattgtcaatagttcgaattgtatatgataactgcagct<br>ttgaaaatttcactgccccctagggagagcaattttgcaaagtatttccaaagaacaataaattcaaagaaacacctttgtcattaaaatcaagaactgatgccgaa<br>ataactgcaggagcaattttttgcaaagtatttccaaaacaataaagatgccctatattccggtgaagacatgctttttgagaattgtga<br>atttccaatgtctcactcataacgaggtgcaatctactgaatctgttaatgctagcatacaagtctgtggagctctgtgaaggtcttg<br>aaatccctatgtgtccctatgtaatgtga |
| Contig40_gene_124_7 | 838 | atgaattattcattatttatctcattgtgatgcattgtgttgttcatgcacaagtctgtggagctctgtgaaggttc |
| Contig40_gene_125_4 | 839 | atgaagtttaattcaagagtttaggatttatctctatattgtttcttacaattctgtttcaagtgtggggcagcagaataaattaac<br>agaaaagatttaataatacctttaaaatagttattccagaagtacagacttccagcaagatgcatattcaaatattgctgctggtaatgtta<br>actttgcaatgaaagttttgacaatatattgaaataatactgatgtgttttctgtactttagtgtactttaagactcttctctgattcaatctt<br>atttccgatgtgattgatgattaaatacagtgggaagttgttgaagaaaatgacaattacatcatagttagaataattatgatgctgaatg<br>gaatgctccagatgccagcacatcctttccagtgagttctcagataggagaatcatagaagattctcagtgcaaatatctagtaagtgatataagt<br>attcaaatatccatctttcgatgtagagtacaacatagaagatctctggcggtcttcaaaatgagacagtggacgtaaatgtgatgattcagt<br>gatggtcagaatgtttccatagtttgcagactattctctttgcttaaagaatcctaaaaagatcaattgattattattgttgtaatgatttagatc<br>tattaagcaaatgcagactctgcttctttcaaatag |
| Contig40_gene_126_4 | 840 | ttgtcaaatattgaaactgatgattcattattagtgaaattcaatatcaagcgatattcattaatgaattcacagcatc<br>aaatcaaatcaacgacgattcaggagacggaagttgaagaacggaataatgatggcttaagcaacaaagcgacaaagcccataccaaacaaatgagatgat<br>acggcagtgacgattcaggagacggaacttacaatggagacggtattacaatggaagaataacccaaagcataaacatgcagtatccaagcagatgtgattcaatcataatac<br>ctatccagcgaacttacacagctattcatcatgaattccagcgacaaattaagcttaaacgacttatttaacaatgcatatataagacgcaacctaa<br>tgaagacaaggcacagccatcataatgaaggcggacaattgaccataataatgaaggcggacaattgaccataatcaactctacaatcaactctacaatcaactctatgaaactacaatgcaacctaa<br>gcgactatgaggaggccatcataatgaaggcggacaattgaccataatcaactctacaatcaactctacaatcaactctatgaaactacaatgcaaccctaa<br>gcgactatgaggaggcc |

FIG. 7B-64

| | |
|---|---|
| | atctacacaacaatttaggaagattgacctatcataactcaagcatttaaacaataagcgcaataacatatgaggagcatctatacacttggagt<br>gacaaacatccagaactcagtttctcaataatcatgcgatatatcagcagcagcgcttctcagcttaggaaacgtgtggcaagcatagcaggaacatagcaacatcaacaactgcagtttcataaac<br>acaatacagatttcctcaataatcatgcgatatatcagcagcagcgcttctcagcttaggaaacgtgtggcaagcatagcaacaactcaacaactgcagtttcataaac<br>cagaccacaaactatacagcagggcaatagcaatcacggaaacatgtttataaacaacagccttttcttcaattgcagtaagattctatgc<br>aggagcaatacttgcacctccaagcgacaccatgtcgtaacagaggtctacaacagaatcaatcttgactataaca |
| Contig40_<br>gene_127<br>0 | 841 | atgaaagaaaactacaattatattggttatttaattgtctcttattgctcgtgttgaataacttattgcttcaccatcatctatttc<br>tacagatgggaataccaacataactgatatggcaaatagaactgttgtaaatattccaagtagtgttgataggtgttgctacaagtccacctatga<br>ccatatcgttatatgcgcacctgaactgttgtgtaaacttcaatgactgaggaactaaaatgttccgatcagtataag<br>gataattccagttcagttatcgtgatggttgacctatagagtcttgaagaagacagagaagttgttcacttcctgagctattgttattgaagtat<br>tgatgaagagggtgttgacatcaactgttgaagaagacagagaagttgttcacttcctgagctattgttattgaagtat<br>ttacaagatagacaatacgatagagttcttagtgctgaagataaggcaaatgagtaattgctttaatgataagtatttg<br>tctcaagttcaatccactgtcaattgatttctcttgatgttatatgcttctgtgaggatgattatccacttgaccttatgcaag<br>tggcgcttcacatgtaatgtctcttgaatcctgatgttatatagccacagtctccatttaagtggttgatagtactaaagagttcca<br>ttgaacagttaaggtcttaagttattatccagataaatattccaatatagatatgtgaggctactaaagagttatta |
| Contig40_<br>gene_127<br>4 | 842 | atgaagaataagagttaattaatattgatataatgaggatatcgctaatatgtcgataatgtcgataactccaatataacaatccaactg<br>tatggataataatataatattgatataatgaggatatcgctaatatgtcgataatgtcgataactccaatataacaatccaactg<br>acataagaatagacaattcaaaacctaaatcaagacagaaacagactagatcaagaaacatctaatcagattaggaagacgattagaacaa<br>agcaatgcaaaatccaatctaaaatgctgagatacaacatctactgtagacgctatctccacataaccgaaagtcatatgtcagatcgacaa<br>aagcgctatagacagtgcaaatgctgagatacaacatctactgtagacgctatctccacataaccgaaagtcatatgtcactgttaacaagccactgacaa<br>taataagcgagattgaacatcaatctaacaacacatgtgactactcataagaagagcagagaatgtagaaataat<br>ggaacagtcctaaaggattcaatctaacaacacatgtgactactcataagaagagcagagaatgtagaaataat<br>caactgtacaatcaatacaggttcaagcacgacggtgacggaataagaaatgccacaaacaacaaaatagctgactgcctaattaaggattcaa<br>acattggaataacaacattacaggttcaagcacgacggtgacggaataagaaatgccacaaacaacaaaatagctgactgcctaattaaggattcaa<br>acaacgataacaactattcaaaattctaaaagctcaagcggagctggaatatatgttaactcaatatccaccaaag<br>cttcattggtcacaatcaaaattctaaaagctcaagcggagctggaatatatgttaactcaatatccaccaaag |
| Contig40_<br>gene_129<br>6 | 843 | atgaagcactatcctgttaagtgcaagtactgcgaaagccgttcaagtgcgaaagccgttcaccaacaggcagatgtactgttcagacagttgcagacgg<br>aatgccttga |
| Contig40_<br>gene_133<br>1 | 844 | gtgcttctcattgctttataggattggttgaggcgatactgatggcattggttgattgggaggacttggcaatatccgttcgcaagtctcctag<br>aaagctttataatgtttgaaggatgagttaggtcttcctgaatgaacgaactgtctgtgattgaaaggagaagcatgaaagaaagtatgctg<br>tcataagagattcctttcctgagttgcctccatggaagaacttccgtcatagacaggagaagccacaagagactctacaaacttatcaatca<br>gtttatgatggagactatgatgacgtcgaaggtccaccagcagcagtcggtcctcagaagagagattcctcattggaaggagagta<br>tccttga |

FIG. 7B-65

| | | |
|---|---|---|
| Contig40_gene_1350 | 845 | atgaataaaaattatcttatccctccttttagtattattagtagctatttctgtctctgcagttgcagcagatgctgatgtcacatatataacgatgctcagatgctgagacgatgttgcagacgaaaaagttgctcctcttacagctagtcgtgatgctgatgcacaagacatccaaactaagcttgataatgctaaacctgagacacaattgaattagaaaacaagacatatgacgttgatacaacaagcatttaatgtaactaacaagtaccatcaaagtcaagacactgtcattaaagctagcggtcatccaagtgctgcatccaagtggtagcggagcactctcattgcaaatgaagctgaactgctttgaaagaattacctccattaacactgacggtggtgtatacgtaaaaactatcaggatatcaggatatcaggatatcagcatttgaaaacggtactgtagacaactgtaaattcatcgactgcgtagcggtgtataccgtaaagcaattaacctttctgtagcattcccacgacattcatcaaaccagctgtatgctatctatcttcggtggagcttcaggcgtatttccattgcgtaatcagtttcatcagatgcgataacgtgtacaacgtaatcttaagatttacctataatccccaagatgtgtaatcgctaacacagtttcatcagatgcgataacaactattgtgttgatgacaaagaaacgtaatcttaagagctatcagtaacacagcacacgaaaaagcagccaagtaccgataagatcggtgacataaacattacaggcaacatacgcaactgcaggctaagcacacgatacccaagtaagatcggtgacataaacattacaggcaacaccattaccgcaactgcagggctca |
| Contig40_gene_1351 | 846 | atgtcgttatccatattgttctgttctgttataggagtggattattaataagaatattattattcgtattctcataattcgtattctcataagtattgatctgtagttgcaaattgatttagattcaaattcagtcaatcaagtcaattatattatctgattgtagatcttttgatgttcctaattcggttttgtccagttctaattgatagttctattgataaggataattatattaagctagtatcaatatattgattcattcaattctaaaatgctgatttaaataatgctgatttaattaataagtttcagttctgatttgaattttaatatgctgatttaaataatcgaaatctcaaaagcttcaactactaatgattcaagcaattcaaatatcaattcaataattttagaaatctcaaaagatctcaaaagatctcaattagaaatctcaaaagtcaattcattgataatgctgcacctgaatcgcctgataatcaagctatcgtttcaaatctttaatatttacaggaaagctattgtcctcaaatcgcaaatcttttaattcaaagattgtaaggaatagttcacagttcctttactatcagaggaggatctgaacaaatatttcagttctgaccatatcaataatccagataccagtcagtgtgatgctaagattacagactgcgattgacattacagactgcgattgacattacagactgcaatatctgcaaatcagttttattcaaagataacgatcatcacagacgtatagtagcttaaaagacatttataagacaagttagcatttaaaaactcgcaatttcaaagatttgaaacactgccatgacaatcagatataatatcactggccatgacaatatactgggaat |
| Contig40_gene_1355 | 847 | atgaacaataaaagattatataatgtcttttctattgtcctattgcaatatctgtctctgcagtttcagcagcagacagcattatagcagacaatcaagttcatttcatccaatgacaattcaatgacaattgctacagaagacattaatgacaatctctttcagatggagtcaagcaccgcaggagacagtctaaactgcagtcaattgctacagaagacattaatgacaatctctttcagatggagtcacgaagatatcaaaaggcaataatatatcagattaaaatcgatgaataagatgaataccaaaagaatataacaattaccaattaaaaataagcaactgtacatcaagcctggagacagtgtcttgcacagtaactacggcacagtgtcttgccaacttatattgcctataaatccagagacaagcaatcaagtgctcttaaataacgaatctgttgccaatataaagcaggtccaaatagtttgttattcaaaaaggcggaccgtattggtttcaggcaacaagcaaagctaacgctattacaacctatgattacaaaacactgatcaacactgaccctccaagctattgaagtgaaattgctatcttaaataccgcctaaacgtaaatagaacctatgattacaaaacactgatcaacactgaccctccaagctattgaagtgaaattgaaggtaaaattaaccttagcttacacttgcagttcacattgtcagtttactctcagtgatgaaagctatg |
| Contig40_gene_1362 | 848 | gtgaataacagtgctgaatacggtgctgcatcatcttgtgcaaatttaacaatcataattatttcctgaacaatgatgccgttgcaatctattttgtgagaaatttgcttgaaaataagcaactagcgataatagcgccaacaagcaatatgctaaacttggctgtcttgaatgctacatcagaaccgatcagcgatcagcagatcagcgataggtatcagaatatgatagcagccgttgaaagagagattaactaacagtgactcaactacgaaggataaatataaatatgcttatgctccttctgagtatcagaatatgatagcagccgttgaaagagagattaactaacagtgactcaactacgaaggatcaatactacccaagccaactgcttacacttgcagttcactactccaaactgggagagaaaaaggttcactactccaagagagtgccgaatgcatgcgtcaacgatcatcatagaaaaatgcctctcaca |

FIG. 7B-66

| | | |
|---|---|---|
| | | ctacaagattaaaaatctcagatgaacaacattccgtgactgactgaacaatctcataaccgcaacgataatgacactatatttgataatgat<br>ttcatctataactgactttttgacagtaataaaatgaataaaattaatggaccttgacaattgttgaaataccatagatgc<br>taccgaatgcaagaatattccgtattcaagcagatgattgtttctgattgcagtttgtaaaatcaatatcgctaaatagacgcaatgtggtg<br>ctatctattggtattgtttctgcgctcgagggtattgtttctgattgcagtttgcagtttgtgattagcactgttactgatgtatgagctgctatctattgaat<br>ggtgctaatggtaatgttctgattgcagttttgtgaacaatttcagttgcagtgctatctattgcacgctgcaatggagt<br>tgtttctgattgcagttttgtgaacaattctgctaagaaatatggtgtgctatcttttgaacgctgccaatg |
| Contig40_<br>gene_136_<br>3 | 849 | atgccggataacactattcgagcattaaagtaactgcttccggtgtaacaattaaaaacgccaatgtaactacagatga<br>tctaggcaatacagatgatgagggcgtcgattgacttgacttgaaaagtccgtaccattgaaaagtccgtaccattgtaattttattataatctcaaacgctg<br>ccggtgcagtatactttatataggaatgataacagcaaagcaataaattgtaattcagcgtatactctgtgttgcttgcttt<br>gaggaaagtggtactacagtaaatgtacttttgtcaataacaccgctcaaggtattttcatggctggtgcaattgctcttaatacaaatgtaatgcga<br>agtaatgcgataaattgtaactttcactaataataaggctcagtgcagcatgccaagatttatggagctactaagatatcaaattgtaattttactgaaaacaaagcagcagaactttcagg<br>aattctgccaacgatggtgtcgtattggaatgccagcgctggcaaatggccagcatgccaagatttatggagctactaagatatcaaattgtaattttactgaaaacaaagcagcagaactttcagg<br>tgatgcggcgctatctattggaatgccagcgctggcaaatggccagcatgccaagatttatggagctactaagatatcaaattgtaattttactgaaaacaaagcagcagaactttcagg<br>ttgaggaagatggcgaagtaacaaattgtaattttactgataacctagacagggagacagcggtgcaattggttttacctccgggatgtaagaaattgtaatttcactga<br>aattccactttattgcacagctgaagcatggatgagtatgcggcggaatgtcttttatacctccgggatgtaagaaattgtaatttcactga<br>taatgaggctgataagcaagtgtgtgcagttttactttaatgagcagtgcagtgctgtagaaaattctaattcacca |
| Contig40_<br>gene_136_<br>4 | 850 | atgaaaatccaaagagtgtatataataattaacttacttgttctcttagcctttctgctgcaagcgcagcagacgatcttacagatgatat<br>tattagtgctgatgagaatgaagaacttatttttagatgaaacagtcattgatgacgttcaaatgacgtttcaaatgacaactatgatgaagaacttatta<br>aagcaaatgatgaaaaatttgtatatgcctgaaatga |
| Contig40_<br>gene_136_<br>7 | 851 | atggaacttaaagtagatcaagataaatgtttaggttgtggagtatgtgttatcgcatgtcctgtaaacgcttccatcagtccgaaaacgctgg<br>aggacacggttccaaaacaaccgaaacactatatatgttgtttgaaaacggattttattaaattcagtgtggacaaatgtgataaatgtggtactt<br>gccaaatgttctgtcctaactgaagctatatggttagaatga |
| Contig45_<br>gene_8 | 852 | atgaatcgaagatcaaagttaataattgcgattttaatagttatcataataggtattgccgttattcttttcggcagtatgtttggtggtgaaaa<br>attatcatcagtgataaagacattttagtttgtgcaattgacgaaagtgagcctcgaccaggagcctgagttgatatggccttttagtac<br>atatgaatgatggaggaattactaattatactccgattttatccgatttcttatcttgcacgattgcttcttattggaagacaaacagtgcatgcaatatgcaatcatctcagctgcagtacaatcgcaggctatg<br>gtgcaggggaaaaactgctcttgcacgattgcttcttattggaagacaaacagtgcatgcaatatgcaatcatctcagctgcagtaccatgcaatcgcaatatcagctgcagtataatac<br>aaattattcctgtgatgcagtttgatttcatcaggagagcagaataagatgattaatgctgtctgtaagcgaatatacagccgaatattgcaatgttatcctgaaggtc<br>tcaatgcatccggtattgattcatcaggagagcagaataagatgattaatgctgtctgtaagcgaatatacagccgaatattgcaatgttatcctgaaggtc<br>caagcggctaaagaccctgctccctaaaggcttgcaagccatgtttggtaa<br>ttatgaattgctcgctctaaaggcttgcaagccatgtttggtaa |
| Contig45_<br>gene_20 | 853 | atgaaagatcaaagaaataaaaccattcttgttgtaatccttttgggattacttattgcaggattacttcgttggtggtcctga<br>cttgtcacaagaaaataaaccatttagctttagtcttagctgtctgataaatacgagcaaactaatggttgttgtgatatggcataccagttcgtttag<br>aaatgtagttagctaattactacctcctgttatcctggtgaatgtatcaccctccaacttcaggcaatatgctg<br>cttcacgattgtctgtgaacggagttgaagacgtatgcaatatgctaaggagattgtggcattccataccgcgttgaagctgatgctgttgt<br>agtcctttatgacgagggagtggacaatgtattgatccatcagacctattgagattgatgagagccaacaacctaagcgcaactgacatca<br>ttcgtgaaaacgataattatgcaggttataaggtaacgaaggtgtaaccggaacagtgcagatgctgttatgttatggttaaagcg<br>gtttccaaacaagctaaagatcctgctaaaaagagcgccatgttcatgcagctttagatgagtagtacactaaggaatattgtaatgactcctaa |

FIG. 7B-67

| | | |
|---|---|---|
| | | aggttctttcactcgttgcttgctacaaaaggattgaaagctttgcatag |
| Contig45_gene_21 | 854 | atgaaagaatacaagatagcaattatagaggaggccagcaggaatgatagctgcaataagagccgcagaaatattaggcccaaatgcagtatg cattctagaagaagaatgaaagcttaggaaaaaagcttcttttaacaggaggaggccgttgcaacataacaaacactccaatccacgatcagc ttaactattacaataaaaacaacttcctaaagcactcattatacacactccaaagacaagctacttgccatcttgaagagaaagacctt gaatttcaccagagacaataaaaaggtcttcccagacagcgaagatgccatgacagctgacatttttagaggatatcttgaagagttagg ggtagatgtgtataacatactccaataaatgctcaagacatagagcatgcatgaaggatgaaccggtatttgaaatagaaaatgaaa agatatcattaaatgcatcaattacagacatcaagccggacttgtctcattcaatattgatgactttctgcttaagacttatccgactcacttaga cacatgaatcatacaacaagaagaagaaaatccgatttaactgtcctgacgaagagagaataaagaccaagtaaacctaaagagcagatgaaatagaggcctgcaatta ttgatttgtccaacagattgcttgaaaaatccgatttaactgtcctgacgaagagatataaaagaccaagtaaacctaaagagcagatgaaatagaggaattgaa ctctttacaacaggattacaatcgacttactccagatcgaagaaaaatccttcaatcaacttcaatattcatccaatgaagaagaccagcccgaagaatgaaa gatgcaataaagaactatatgaagaactatggaagaaatcctaatgaagatagaca |
| Contig45_gene_30 | 855 | atgcaaatgaaggtgaggacattgagagatctaaagactatttgatgattataatcttaatagcttttgttcttgcattaggagtttcagttat aatggaggggatgataactctcaaactgaatctgaagtgtgcactgttaatgtgcactatgttaagtgaataaacattactgaatataatgaaagcgggaatc ttattgaaaccgaagtgcacacatagaatttcttcttacagcgacaatgtaactgaaggagaaaacgttacagcctataattcttcaaca gatgcagggaatttgttttaa |
| Contig45_gene_35 | 856 | atggataataaaatcaaagcaggcattgcacttgcacttgtttactattccatgaaagttttgactattccatgaacctatgacaacttgggatgattctaaaaggaatattcctttaatcaga acatcagcagtgcaaacgtaaagactataaggacatcaaccatgatatattgatgtataacgatgaaatcctagataagcatacccagcact ataaatagcactaaagacggttcattcaattcaaattcactcaaagctgaaggagaacctgatgaattttattataatgtgacaaggctac tgaaatataa |
| Contig45_gene_36 | 857 | atgtttaagtaagcaaaagcatattaatcgtttgttttagtatccctttccattagttcacaagctagcgctgcagactctaatggcttaag cataagagatattaattcagttgatgaaaactacaatcttgatgcagtatcttgactcctccagatcaatgcatgcattcagattcct ctctaaactctaatgcttagatgataagtcaaactatgacaagactcaataaagctaaaccctcctctaacttaaaagacaatgatttta gataataatgatggaaaagcgagattattgaagaggaagctaaagacaccgaaggtgtagtgatggctgagacagctgagcagctgcggaccgc atccttgcaactgcattaaaacaggcttggcttaaacctagcctatctgaagtatccagcataccaacaccagcaaggatgaaccaatatgc aatccttaatcgatgctgcaggatactacaatttctctgcagttgagttgaaatccaatccaaagactagctgaaaactccatagtccatttg gatattgatggagcagaacactggactgtagtaagcaaagtaactgaagaaagtgtctttttagctgactcaacaagggaaacatcaatagag cattgatgaattcaactccctcttttagcggaaaggcaatcctattatctgaattgaacaaaccaatgtttcaaatgtgatatccaacaaaaca ttaaggttttagatcaatcccaatgcttaaacgtaaacaaagatggtttaggtgctgtaggttataagaccgaatggagatacggctta atcaacacctattcatggtgctaagaccaaatcatcaagtacatcaaaaaccaatacaagtactatctcaaataccaatcaaaaccaatacaagtactatctagttg gggaaaatataaggtcaaagtcaagtacctactctacaatcaagtacatcaaaaaccaatacaagtaaaacatcttagttg |

FIG. 7B-68

| | | |
|---|---|---|
| Contig45_gene_60 | 858 | atgtggtatgatgatgaaagaagaagtttattattatattattatattcatattgatttagcagctatagcaatcatagaacatttcaag<br>cttcagtgatgtttccggatatgattggaagtgatgacctatccattgccgttacagggatgtgatgttcgttgtaactttgaaaaccgctacatattcc<br>tagattccggagcaagccattcagaatgttgaaatgtcgagcctgcagacatttgctgtaacttgaaaaccgctacatattcc<br>accaatccagtgaaagggacgttccttaaaggcagacccctaaatatgtgcatctgcttgctgaggccaatgagatctgtcattgcatctcagga<br>caataaccatgcattgattatgggatgaaggattgaacgacagcatcaaaaacctaaggatgcagaatctatgtgatggagctgaaaca<br>atctctctgaggcatctaaacctgtagtcatagaaacctgaggagatagaaaggtaactgttaaactatatgatgcggataacttgcagaatat<br>gcaagcatcatgcctccggcaactgcaaactcatcaggattctgcgcatatgacagcgagcttgcaagaaaacaagtggctgaggctcgcagaa<br>cgaatccagcagcattgcctgcctatatgcattatgaaacgagtatagcaggatatgacaggccctaatgagtatcagataaacatgtcccatgagctgattg<br>acagcgtgcggatattgtgatattccatgccatgcaaccaataggtcttatttcctaacttggatctatcaggtgaactgtatcatggtgacattgtcagtgactctctatccgac<br>ttcatattcgatcagtccaatcagcaaccatagtcttattcccttaacttggatctttcatgtgacaattgtcagtgactctctatccgac<br>tgtgatagtcgtactgcctcaattcatgatgctgattcagctaaggcattattgcagagttgtatcctc |
| Contig45_gene_64 | 859 | atgaaaattacagttgcgggttgcgggtgtaggatatgtaggcgtttcacttgctgtctgctcaaaaacatgatgttacagctattacaacaaccga<br>atcaaagcagaaatgctaaatcagttcatagctccatctccattccaggacgatgagataaagatctcttaaggaggttcgtgaaggaagaaccc<br>ttaatctccatacaactgataaggctgcgcttatgggtgcgatctgttatcatagccactcctacaaacttgacgatgtaggcaat<br>tcttgacacctgctgctgttgaggacgctatgaatgaccctaaggtaaatcctgatgtccattgtcataaagtcaacaatacctgtagg<br>atatacagaatctgtcgtgagtgtatgaagcagaatattgaacacaatcatcttcagccggaattccttcgtgagctcagtcacacctcc<br>atcaagcagaattgttgctaggcgtgatgacgaccagatgagacggtcagatgttgcagatctacttgaaggcgcttagaagaaggag<br>aaaagcaaactctcttgacactactaacacatacacaacccatgcaaagccttgacacacaggctatactcgtcgctaaggatacaaaacagctcttgcacaacacttgc<br>tgtaaggttagctactcaatgagcttgacattcttcatctcatttcggatatgagatacgatccaaaggccttgcctaaggatactgacacacaaacgctcttgcaaatatgacgcctc<br>gtatcggagccatttacaacaaccatgattgaagcagtgtttgttccattcatcttgatatgcttggacaattgctgctaaggatactcttgacggagtgtgatgaccctc<br>cctgaaaccatgattgaagcagtgttttgcattcatcttgatatgctgtttcaagaccatcaagatgatgcaagtgcttgcaatttataaggatgtt<br>ggtctatagacttacaatgaagagtaacagtgacaattccgtgcatctgcaatacaagatgtgatgaaagta |
| Contig45_gene_89 | 860 | atgaatttgataaattacagttgcggagttgcgggagtggatatgtaggcgtttctattgctctatcttctattgctcgccagaaacatgatgtaaccgcaattac<br>aactactgaatcaaaggcagaaaaactatccaattgaataccaattccatagtccatcaagtcccatcagatgatgagagttttttaaggagactcgtgatgaa<br>aaaggaaaattaaacctctcacacactcagtgtttgttgtgaaaaatcgatcgcatatagaagagatcttgcattatagcagcaccgacaactatgatgat<br>gtcaaccatttttttgacacatcagctgtcgttgtgaaagatgcgtcaaggtatatagcagcaccgacaactatgatgat<br>acctgtgaatatagcgagtctgtcgttgtgaaagatgttgccatagatgttgaaaacatgtgtcaaaaacatcatatttctccgaattcctcgtgagctcattaagtcaacaat<br>atatgctccatccaagcaagatctgattcctcaaagtaattgtgggatgacgaccaagagatattcctatttcacagagttgaagcaagcagcttttctttgaaggtgaga<br>ttggaagaaaagatctgattcctcaaagtaattgtgggatgacgaccaagagatattcctatttcacagagttgaagcaagcagcttttttccaaaacac<br>ctatcttgcattaaggtgaggacactaattgaactttcaatgcaataacagcaataacaacagcaacagcgatacttccgcgcatccgacaggatgtta<br>tgaccaaagatcgagagatcgagagcccctaattgaactttcaatgcaataacagcaataacaacagcaacagcgatacttccgcgcatccgacaggatgtta<br>aggatgtccaacaggctcattaaggtgaggacactaattgaactttcaatgcaataacagcaataacaacagcaacagcgatacttccgcgcatccgacaggatgtta<br>acagttgcatataggctcattatgaacagcaacagcgatacttccgcgcatccgacaggatgtta |
| Contig45_gene_91 | 861 | atggagataagataaaatttattaaaagttttactatttctgttttactcatcagttgcctcagcagtcagtgatttaga<br>tgaaggtaattctgcaaatattgttgataatgtgataatcattatgacaatatgatgaatctgcagataattgtaaaatttgaaa<br>ctattgagagtctcattcagtgaaaaacactgttaaagacgtttcatatgaccttcaacacctatagatgaaatactttgaagat<br>atccaaactgctattgataatgctgctgatgagatattgaacttaatggtacttattattggaaacggtctgataataacgttacaaaaga<br>tttaacaatcagcaggaaatcttgaaacaataattggatgctaaaaacaatcaggtatttttatgttaactcaaataacgtaactttacaaaact |

FIG. 7B-69

| | |
|---|---|
| | taaaatttatattcaatagttcctgaatatgtgaagtgcggttcattttttaagtaatggttctgtgattaattgtactttataaataatact<br>gctggtggagtttatgttactatctgtgattacttttggtctactggagtgtagtatattggccaaggcaatggctctgtgattaattgtacttt<br>tataaataatactgctaatgctagatgcggtgcggtgcaatttattgtggagtgttgatgcgggtctgtgattaattgtacattattaatatactgcaa<br>aagagttaggggggtgccatctatattggcgcggtcatgacggtggcggtgcgctcattattcaaatgtttatgattgctatgtagataattgctattt<br>attaacaatactgctgtgaagtgctgtggatttattatgcggaggcggttaatatttaattttgtacttttattaa |
| Contig45_<br>gene_93 | 862 | atgaagataagatataaaatttattaaagttttactattttctgttttctcatcagttgcggatttgcctcagcagtcagtgattaga<br>tgaagtaattctgcaaatattgttgataatgtgattttatcatcatctgacaatatgatgagtgattctgcaaataattgtaaaatttgaaa<br>ctattggagtcctcatacattagtgagaaaagcactgttaaagacgttcatatgacttcaacacctatagatggaaatactttgagat<br>atccaaatagccattgatgatgctcaagatgggacacaatccaactaaacgcacttatctttggaaatgaagcccataattttttcaaaaa<br>cttaactattggagtagcggcgaaacaatttgatgctaatgatattctggcattatcaatctgtctctgaaaaaatgtcttgaaagatt<br>taacatttgttaatgggtctgattcacagttgatttgaggagaataatggtgataatttaaaatattgctcaataattaattgttccttgaa<br>aagtgttatggggataaaaatctgccgttatctgtttaaagatctgttaattgtgattgtgattttcactatactaattgtcactataaa<br>tattggttctgaggatgtttcatttaaactctcttttaattatactgcggatatgctatccatccaatgcaatatttgttgattcactattt<br>catgtgattttattcaatagtttctttcaaggcacatattatgaaacatattgattcctagtaagtgtacaatgtcctatataaggaattca<br>tcaatcagtgatttgtatgttgattgtataaattgtacttcattagatctgttaattgtacacagaatttctgttctgccatttacc<br>ctgtgatgaagttgatgttatatttcattagatctgttaattgtacttcattagatctgttaattgtacacagaatttctgttctgccatttacc |
| Contig45_<br>gene_100 | 863 | atgcaacgttcattatttgataaagttaaaacatccttatgatgcttccatcctttttgattgtaaacgcttggattttatctatctcgg<br>acgaaagaatccaactcgcattttcttaggatcattatgtgttctataagcattgtccgctctgtaatgttgataagcaaatcaagaatgtgtcaattcaacgaaaaggaagcttctcctaa<br>caatcactcgcattttcttaggatcattatgtgttctataagcattgtccgctctgtaatgttgataagcaaatcaagaatgtgtcaattcaacgaaaaggaagcttctcctaa<br>gaatatggttcgtcctctgttgaaagcggttctcatgttgaaagcggttctcatgttgaaagcggttctcatgttgataagcaattatgatgggagaatcaagtcgacaagtataaggctgaaatca<br>ggaagagaaagttaatataatcctattatgagaagaccttttcaattccaggacaatcattggaaaaatgatgaattaaggatgagttgatcattaatatgacaactg<br>aggaatgaacaattcaatgcagaaacttcagaagacaatcaattccaggacaatcattggaaaaatgatgaattaaggatgagttgatcattaatatgacaactg<br>atgttatcataaggattcagagacttttcaattccaggacaatcattggaaaaatgatgaattaaggatgagttgatcattaatatgacaactg<br>cgatgcagagataagaaatgaaatcaagaatctctttgaggatgacatctgaccagtccagttccattaagcatctgaataa<br>agactggttcagatggtgaaatcaagaatctctttgaggatgacatctgaccagtccagttccattaagcatctgaataa |
| Contig45_<br>gene_106 | 864 | atgaaatttaagaattcacatatcttactgttcattaatatccattttcctattgttgagcataagcgcagctctgcagctgactctgatat<br>tgcagcggatgacagctcagtgatctggatattgttgaaatagaagatataaatgaaagaagaagccactatctctgtgatgcctctactgctcag<br>aagatctaagtggtgataaaatacaagtgcactcaggcactgatgacgctgaaatgaccactgatcaaatgccaaccaataataccaagtga<br>aatgctacaagtgtaaatgcactgaaaatgttactgataagcacttctgattatcaatatgaaacttcacttcaaggtggacaatgcaacag<br>cggtcctgtaaccaatgcaacaatcattcctgtaagcggtatattttcttacatttaataacgatcatccatatccactacaaaggtattcact<br>gagagcctttgcaaatcaaaagtttgcttgtcattgcaaacaagaacttaaataagaaccttgacacacttggtatgtatatatttcaccgctctttgatgt<br>accaacagcaacgtttgcttgtcattgcaaacaagaacttaaataagaaccttgacacacttggtatgtatatatttcaccgctctttgatgt<br>ggcaaatacgaccttacctttcaaagatgaagttgaacaagtagacagcttaagaatttgtcaacaatacatttaagcttgtaaataagaatacaggtactgttatcaattagcc<br>ttaaggcaagcaacttcaaagatgaagttgaacaagtagacagcttaagaatttgtcaacaatacatttaagcttgtaaataagaatacaggtactgttatcaattagcc<br>agcctcaagttccaaatcaagttcagattccagattcgcaataatgatcaatcaaccaaccaaccatataacccaatactataacaccttcagtcaagtcagtgcactgtaagcctgaacct<br>tttggccggcacatatcctgttagaatcgtcaataatgattcaaatctaaagctcaagctcagtcaagtcagtgcactgtaagccgcaatg |

FIG. 7B-70

| | | |
|---|---|---|
| Contig45_gene_116 | 865 | atgaattctaaaaagatagcaattgttcttgaataatattgctttcatttgcaattgtaggctctgcatcagctttaacttatttggcgacc<br>tactactgactttgacaataaattcatgcagtcagtacctttacagggatgtaagcagaaacaatataagcaccaatgactcctatccgactggg<br>tggactcctatgaagctcctgaagtgaggaattcaatgtgaagattgaagtgaagtctattattctcaagcagttcctacaacagatgaaaacaagacagctaa<br>atgcagctcctatgaaaatgtctacatctgtgaggcagatgtgataatgtgacctattgattaatatcattgcatatgcaatgaatcaattg<br>tgaatcagtgatgcagtctctactgcggattctttaaggatgacattcagcctttattagagagcattactcttaaggatgctaagaaggctccgcaa<br>actgtgatggcagtctctactgcggattctttaaggatgacattcagcctttattagagagcattactcttaaggatgctaagaaggctccgcaa<br>atatatgatctcttgaatatgactaaagatgattttaaacaattgcaggattatataagaacaggtcaaaacaggaaatattcctgaaactgctga<br>aggatag |
| Contig45_gene_142 | 866 | ttgtcaaacagtaatacagatagctctgataatgcatcagatgatgctcaggatctgaaatagtatcaggaataacgaagagctgaatcaaa<br>taatttattaactgaagcttaagcgtaagcgatgtaatttacaactagcttttatacaagttctttatacaagttatgcagttaaatctgcaaatctgcaaatctctactg<br>tattaactttcaaaactctacagtgtaaaggagataacttacatttacttaactctaaagacagttccaatcatggcattccgcgaaagta<br>atatttaaatttcaaatccatctaaacaaagaactaccgattcaaatggccgcacttgacttaaactaatacaaacaaatatgcttt<br>ttcagcaatataatgatgcagcagataattacagcgcttccagaaagactttacttaactgttgctaaagtcaataacaaagaagttgcttcaagct<br>caagtgttgtaaggggaagaaacctataacacttattaaaggataaaacaacaatgccctttcaaataagaagataagcattaccatctctgga<br>aaaacatatacgttactacagacaaaatgcagaggcagagcttaaagtttaaagacagaacttcaagttttaaagacagttcgacaattcaagttttgctgg<br>agataaaacatataactccagtctcttatcaaaagataaaatatatatacctaaagacagaactctcaggcaaagttgcacagatttgacaaaatctactttaacta<br>gtcaatatatttatgcatatcaaagacagtcactaatcagtatacaagactaaaataacaagacttaaaatgaaaattgacaaaatctacttttaacta<br>aaaacagacaaaaacgaagatgcacaaatcagacttattgtgaaaaaaccagatacagttgaaaattaaaagcttcgcaggatcaacatcctactc<br>agcaagctcaaatcagtcactattacctctaaagttgaaaaaccagattacagttgaaaattcaacagtga |
| Contig45_gene_159 | 867 | atgatgaatgtaaacttgtattaatcggttttgccgctgtaggccaaggtgttgcacgtgcaatatccatgaaaaggaaatgatcaatgagaa<br>gtttggcataagctaaaagtagttgcagctggtgatttcagctggtgattcatcctgaatatgccaagacgtttggatgaggaattgctcctaagacta<br>aagaggaaactgcaaattagcaaactatccgaaggagcacatctctggaattgacatcttagatgcagttgactatgactactcatt<br>gaagcaactccaacaatattgtagatgcagatgcagacctgcaaaatcctgaagcattgcagaggcagagtcagcattgaaggagtcgacttaaggtttgaagcctcagtcggcggaccatcgc<br>gggacacctgcactttctataaggaaacattgcaagctgtggaatcagctcagatgctagagtccaacaattagtattgctgaaactgacccctacacaagacgtagagggtat<br>atgacaacagaagccatgtaaggcatgacctatgagaatacctttagcagaataacctttagcagcaactgtccaacaattagtattgctgaaactgacccctacacaagacgtagagggtat<br>tgatgcagcatgtaaggtagtaatcttgctaattctgtttaatgtcaggaaagaactgcatgcaactgctgatgcaactgtggaggaatatcagatgttt<br>cattagagcaatcaatctggccaaggaagaaggctatatgtcaagttgcaggaaagcaattgaagttcaagttcaacttaggaaacaattgaagttatctccagacactt<br>gttaagaaaaaacagtccattgcaagactcgtacctaagcttgaaacattaacagactcgcagatgacatcactgtaatgggtaaagg<br>tgcaggttcctggaaacgcttcagcaggcttacagattgtgataatattataaagaataagtaa |
| Contig47_gene_98 | 868 | Atgggtttccttgataatgttaaaaaattttgattctgtgaaatagaggttaaacctcgaaatgtaactcgaaaatagataaagttga<br>atctgtagaagtaagtaattatgttaatttaatgaaaagataacaacaacaaattcagaggaccctcattaatgatgaatacttgatg<br>aatcaacatccaatgaaactaaaactagaaattcacatatctaaataattaattctcatagtggattaaagagatatttttgattcgatattgttat<br>ggtaatgaggatgaggaatccagacatgcattaacttcgataacctagttattgatggtaatggtatacacaatagatgctcttagagc<br>aagcgaaatatttattgatgctaggaatatgtctaggaaatatgtgataaaaacattacattaaagaatgggttttctcatcaggctggggcaataaataatc<br>aggagagtttaattgcttaaaaataaggcagaactactggagaatacttaatttctttggtaagctaagcataacaaatccacccctcaaagaacat<br>tctgtaattgcaataagcaatatctaataacggaggaaattaactaatcataaccagatagacacaagacaaagacaaatt<br>tggaattggcaataagcaatatctaataacggagggaattaactaatcataaccagatagacacaagacaaagacaaatt |

FIG. 7B-71

| | | |
|---|---|---|
| | | ttgttaataaagccagacagacagtatttgttaataaagcacgacgtgatgcagttatatcaaatgggttatttaaggataagtgat<br>tctgaaatttaagtaatgaatcaaagtatataattttaaacatagagttctcaagaatatataataatactatttttaaggctaatgagtcacaata<br>tatcatatataatgataattatgaggataatggattatctcagtttagtgtattttaattgtaaattttatagaaa |
| Contig47_<br>gene_7 | 869 | atgatgaggaaacaatatttggagttatatttatcgtttttattttattcagcatttcaacggtttcagcaaacgatgctcaagttgacatgct<br>taatgatgcaagtgatgtgtggaattaaatcaagactgaatgctgaatgctcagcctatttcatcaaattgctatgataataatcagaatttaaaagctcaac<br>ctatttcagattgctctgatgagctacagaaatctgatgatgattaaagcttcgaaggggtcaacaagtttcaaacagcttgtgaagat<br>ttaaataaagcgacggcgaattaatctaactcacagctataaacattga |
| Contig47_<br>gene_8 | 870 | gtgataaatggaaataataatattatagatagcagcaaatcaaatttcaactttaaatttttcaatgaagcaaacattaccatcaatgatttgac<br>tttcacaaatttcaataaatccctatttgtaatcagtgacagccaattgaccttttaataacgttaacttactaatttgttcctcaaatctttcat<br>tgattgcgataatgttttcctagcaatttgactataaacaactgtaaattctctattcaaattcatttgcaaattatctcgacgaccattaacaaa<br>ttagagatttataattcaaatttgatgggacaatatgttttagattctgctattaagagaataggggccaactagtcattgaaaattccagctt<br>tgagaatttcacaggggttcatggaagcaatatattttccctattgcctatgaagaaggagattcatttgtctatcgtcactctaatgacatgctgattgag<br>tcactgaggagcaatcattgtaaaatatttccatctcacagactgccactccaagtgaagtgcaatccatcttgacctgattcaggctctgaaggtattgtagaaactttaat<br>aattgcacatttcttccaacttccacagactgccactccaagtttggaggaggcaatatccatttaggcggttatttaaacattttcctattccaatttcc<br>tgtaaaatcttccaacttccacagactgccactccaagtttggaggaggcgatctcctcatggaccaatgcaaagattgaaggctctaatttttactgccaatgaaggaagt<br>aaacaatagcgcagcttatactttgacaaggaaaattgacaatcaatgactgtaagttcattgataataaggctcttaaggaacgagagaac<br>caaaatgcagggcattatctcatgctgctagctgcctattcttcccaatcttctccacttttgacaatggaggagtatcag<br>tgcaaatgcaatctatgctcatgatgtagctgcctattctcccaatttctccacttttgacaatggaggagtatcag |
| Contig47_<br>gene_13 | 871 | atgaataaacaaaacgtatttgctttgatattattaacaatcatcttttatctgtagttgctgtcagcggatgcattgaaaatcctctgataa<br>ttctgcaagcgattcatctgagattccgatgattccagtaattccatattttcacagtgctctgacagtgacgatgctgacgattgacaata<br>atgataaggacgacaaaaacgataatgataaagacgataaaagatgatgatgacgattga |
| Contig47_<br>gene_57 | 872 | atgttgaataaaaaataataataatttattttaatattgtctattttcttcagcaagtgcatctgcagattcaacagatgcaacacaat<br>ctatcagtgatgattctgcaggcttatcaattctagacaattctaataatcttttattagatgataatcaatttaattttagctaattctaattt<br>cagataattccaataacttaatctagatgattctaattctcagatgataattctaacttttatctcagatgaagatttagacaataaaatcaatgaaaat<br>ataaaaaacactaaaacaatcttaaagagaataattcatcaattgctcctttcctttcaaacctttcacatattctcaaagcttcagcaggaga<br>tacaataatcttagaaaatgattataatatgagagccagaatattctatttggcttcagaacaatattgtcttaaagaacatcaagttataaacgtttc<br>acaaccattatatcgatggaaatgaagagagccaatctatgcaaaaggaacaaaatgtcaatataactgtcatatttgaaaacaatcttgccccagataatggaggtgc<br>aatagtcaaggggaagccaatctatgcaaaggaacaaaatcgtaaaattcataaattcataaattaaggggagcagcataatcctgcggatatggaggctcaagcagtcaagcagatatataaactaactgtatttt<br>aatctatgttgaagatctgatattcacagaaggtgctcaataattccagctaaagaaagccctaaagaaagccctatgactccaagtgaggatgttcctttgatgaatcaga<br>tttaaattctacagatgattctagattctacagatatgatgataattctacacgattacaatttcacagata |
| Contig47_<br>gene_60 | 873 | Atgggagtattagctagtgttgctgaggcataattttgaagcaggcatgattgctacttgtacagttgttgttgcctgtaggtttggctttt<br>aatggtgtaggtacaatttgcactgctcttgactgctctggtttatttgcatgacagacacggcaatttctatctatcaactgatgaaaattt<br>tagccgattttggcttttcaatgagttcaatctcattgggagggtatagtgcagctgcgctgcgaaatctacattaaggactgtaggaggtaaa<br>tcggttcagatttccatatctaaagcggcattgcaagtgaccaaagaggtgcatacaccactttcatacaattagttctaaaacatatattca |

FIG. 7B-72

| | | |
|---|---|---|
| Contig47_gene_62 | 874 | aaaagttgaaaatggtgcattcagtaactgtggagaatacttaatagaacaagaattgaacaacagtaattgaaaataagaaatcattaagagtttttatcaattga |
| | | gtgttttcagtgagttaaataaacttaagattggtagagttttattgtcttttattttagtttctttttgttcaattaattgtgttttgcagttgatgattagcttcaatgatcatattctgattagattctgttaatgggattattcaggttttctagtgaaggagacttaatggaggctcttctgtgttgttgtgttgaaattgactcctccaattgcaataataaaagaattcttcatttgccctactagcaaaaggattcatcttcaccttctattccacatccacatagtgtctgatgaagatgtaatcggacctggtcatgaaaacttgaaaaactggactgattaacctaacacatgtcacaacgtgtattttatgaccgcgacatagtcaatgatggtcaaagggaagatgagcaaagattgccaccaccattgtcgcaagcaacctagttaaatattcgacgacagcctattttcagataattcaaaggaagatgagcaacttacctctccgaaaaacaatcaatttcacgtaggcagcgcttctatctcaatgccagccaactaaatgtcggcttgaaagactccctaacaatcaacctaatgcctggctctatacttcacaatcagattcctaggagactatacatacgcaccaccaactcatcaggcagatgctccctaacagtccacagtccaaagatgcccacagcatcacgcaagcaacctgtgaaatactatcacaatcctcatattcccaagcagcaaaaatgtcaacgtcacacaactagagccaaccccatccaacalgacaglaacalccaaatygyalcaaccactataaccgcaccaccaacaacgcaaagccacactagactcacataaaaatgatccagaaacttctccgtaaaataagct |
| Contig47_gene_4 | 875 | atgggaggtgaaataataatgaaaattaagtaattaattttcaatattaattatgaatacagtcagtcaatgcaagtgacaatggtatcattgcagaatacgctgatatctccaaattccaattccaaatgtttctatcaatgaaaatgactactgataacaatattattatggttacctgataaaaattagatcagaaggcgatgatcaagtcaaaaatcattaataagataaccttagaagcaaaacaaactaaatgatgaaactcaatatgattttaactataataaaaacctaataagtcatcaagagttgatcaatagtcaagagattgagagcaaaaacaatatataggcaatgaaatccaattatcattatcataaagggaattcaataaatcttatgataagctttcaatcaatgccttatcaagcttatgagatgagagccaatctataacaatgactattgagtatgctgcaaacaatagcggacttcgttcaattcaaacaaatcttcaaacaataaatacgattgtgaaagagcttggaaagctaacatatctctaattccaccttctcctttaacaggatgaaatataagcaatccaaggattgaaaaaagcctggattggcgtgagagcaagcttggaaatgcaaatgcaaatgctaatctctaattccaccttttaaactctgcaagccaattaggaggtactgttaaatctcaaggctgttatctacaataatcatgaaccctatcaacatccacaatccaaaacaatactgcagacatgtacgagaggatgctcgtggcggtgttatctcaacatcaggaaatataacaataacttcacatcaagaaacatggaattgtttcagtgttttctcgagtctctgtattgatgaaggattgaaagtagaactgaaaagcaatagctctgaaagtaagtaaacttaatcgtctatttctgaaggccttaggagatccatctgaaaggccaaattatatatcgagacagttgcctgatggagtccttaggagctctgaaggccaaagactattatgaagggatatccaagcgcaactgatgcaagcaagctccttccttctatatgtcaagaatgtgcaagcttaggacgtttaccaattcagaagaaaacgtcaactgattttcagcatttgagcattttgagcattttattatgatcgcaacgttcttggcagcaatagttatgagcggtaacgttagaaaaacgtctattatgagcgaagtgtaactttcagggcttaggatgtcctgtatgtcaagaatgtaaaaatacatcggcgaggaatatgtgtaacttcaggggcttaa |
| Contig47_gene_125 | 876 | atggataagaaaatgattgtttcagtgcttttcttttttgatttggcagtggcttagtctctgtattgatgaaagcaatagctctgaaagtaaagtaaacttaatcgtctattgcttaggaagcccaaagtaaataagaaatttcttatctgaacctgtcaatgaaattagacccaagactattatgaaggatatgacaatgagacagttgcctgatggagtccttaggagctctgaaggccaaagactattatgaaggatatgacaactgatgcgcaactgatgcgcaactgatgcaagcaagctccttccttctatatgtcaagaatgtaaaaatacatcggcgaggaatatgtgtaacttcaggggcttaa |
| Contig47_gene_140 | 877 | atgaaaatctcaagaataattgtattattaatgattctaatcttcactgcaggaatggtttatgcagtagattaagtgaattaaacttaalLLaagttttaaattctctcccctttaa |
| Contig47_gene_146 | 878 | atgatttctaaaaatattagttcattttaggtttaactgttttagctattttttagctagtcagttcagtgctgattcactggggttatatccagtatattaactgttaaggagcgatttaacattccagatgatttaacattccagatgattgaaggaattgaagaattgaggagattgaagaattgaggagattgaagaattgaggagattaaatttcgtgttgattttagacaagacagttccaggagtcttttcatccatccatttaaataggaagtttatggaatcctaaagttatggaagatctaaaggctctaaaggctcctaaaggctcctaaaggctctataccgctaaaagcaaagaagaattgcttgctatccaggtttattggctctgagatattgattttctttatcttatgtttctttcttatatttgataataaggtgtctctatccgctaataaggttgtcctatccgctaaaagcaaagaagaatttgatttgattaatcaggttgatttgattaatcaggttcgaaactccactaagttttctttcttatgtatttgataatttgataaataaggtgtcctatccgctctatccgctaatacggttgattttgattttgattaatcaggttcgaaactccactaagtttcttatccgctctatccgctaaaagcaaagaagaatttgatttgattaatcaggttgattttgattaatcaggttgtcctaggatgtcctatccgctctatccgctaaaagcaaagaagaatttgatttgattaatcaggttcgaaactccactaagtttcttatccgctctatccgctaaaagcaaagaagaatttgatttgattaatcaggttgattttgattaatcaggttgtagttcttg |

FIG. 7B-73

| | | |
|---|---|---|
| Contig47_gene_160 | 879 | atgaaccatatgtaattctcatggaagcgcttcaggataggaaaatccacagttgcagctgaacttgcaaaaacattaaacattaagcactt<br>ggtgaaaccgattttataagagaagtagttagagaatcataggaaagaaatcatcaggatttacttcactcatcatcctacatcatcctacatattcca<br>gccttagaaatcaggaaatcaggaaattacaaaccaagcagagcttatcatagaggattcaatgcaggatttgaagagcatgcatcattgtcttcagcagtagaaagg<br>gtaatcgataggggcaataaaggaccatgatgacattactagaggaggaccacaagaaccgattgtaaaagagccatgaaataagagggaggaaagc<br>ggcatcggtcttttcttcatattaagctctcgatgaataacagaaccatcttatagaacagctaaaatgttccaatcataaaagctatgagatt<br>agctagactacttaggaaaacagaaatgctatcctacattaatgaaacctgtgaaacacacagttgatgaattgataaggtagatgaagagaga<br>gaatcaaccgtcaagaagatacagcggaagcataaaagaacctgaataaatatctcgatcaaggatttaaagagcctctcataagaaagatagtaagcg<br>aatcatattagacagataagtttataaagaaacctgataagttccagagaaaaaggaagaacttaaagaactttataagaagaagatataga<br>agataaaggaatatgataagttcaataaataatgaaacaattgaaaaaaattaaaaatgaccttgataaggaaggttgctcttttaaagaagatatgtaa<br>gcatatcgcattgtgcaattgcaatataatgaagaacaattgaaaaattaaaaatgaccttgataaggaaggttgctcttttaaagaagatatgtaa |
| Contig47_gene_197 | 880 | atgttaatatcagtctgggagtgattgtaattatcattatgtagtgcagctgttggattagcgttgttcatctagtttgactgg<br>tgaatttcctctggtactccaatatgatgagttagcaacctaaaatccaattgctctagttagaagcccaattcaataaccgaactaaga<br>tttatgcaatgcaaaacattacccttagaaagagagtttgtaaatgctcaagtggagttaattaaggttaaaatgattggatagtgttgaaagt<br>gcattggcatccggtcagcctgcttcagaagttgataaaagaataacaacaatcaaaagagattaaaaatagctcagcaggcttataatagtt<br>atctgttaaataa |
| Contig47_gene_208 | 881 | atggcaaccagaacaacaaaactatatgcaggttgtattccttccatggggtcgtttctaatagccctgtcagttttcccctaaacgttc<br>ttgcggtttattattgatataagatctcctcctgagaagaaattggcattgtctttttaaattttttctctaaatga |
| Contig47_gene_253 | 882 | atggaattaagtaaaagtgacaaatatttaatcgtagtaggattatttctgtcttgcattagcagtattatctccttacattgcatctggaga<br>cccagatgattagaaaatcagcagagatgcaaacgttggcaaacatgtctatgcgaagatgttgaagctccattccagactacctatg<br>agccttagaaaaataggtgaaatcggcgtattgattctaggcgcgctagcggcttgataacactattgttgcatgggtatagttatgcattgaaaaga<br>tctgaataa |
| Contig47_gene_269 | 883 | atgaaagtagcaattttaggtgctggctgttacagaactcacgcagctagtgaattacaaattttctagagcttgtgaagtagcagacgcaac<br>cggtaaagaaaacattcaatgacgcgaattcactgtgtagagaaatgggtgcagaacttttagaattagcaggtgtagacgaagttgtagtagctgacc<br>ctgtatttgacggcgaattcactgtagtagaagactttgactatgcagaagtaatcgcagctcacaaagctgaaacctgaaaacctgaagatgtaatgcct<br>gcaatcagagacagtaggagaattagctgaaacctgaaaccgtacctaaaccagctgtcatgcctaaaccagctaaccagctggttcgtatccagaacctggttacccagaaggaggtatgcaacctgctatcatcgaaaat<br>tcgctgatgtaattaagacgttgaagaccgtcaatcgtaccctgcaatcgtcatccgcatgtaccatccgaaatggaatccctgattaaaccaatcttgaagacttaggcaaaac<br>gtaaacgtagctccctaccaccggtgcaaaagcaagaggttcgcaaatcctacagacactgtaactcaactgaaaaatgatgctcttaaacctggcaccagaggttgcttaaacctggcattattagtactgctactcaat<br>caattacctacgctgtcttttatcctgaaattgtacctactatcttgaaggcagaaagatcttagaaaaagatccaaatag<br>gaacttcgtccattatctgaaattgtacctactatcttgaaaaaagatccaaatag |
| Contig47_gene_304 | 884 | ttgtcagttattctgattctgttttagcagttcaacgtgtagcagtgcaattgatgtgatacgaatgataatttggatgatggtagttcttcaa<br>ttcagatttaattagtcttcttcttcgattcttcttcttcgatgatgttcttctagttgtctagtgggtttctagttcttgataatcacttg<br>atgaaataatttgtctgataattgtctgatgagtcgttggtgctatcttcttgatgagatcgtctatctctgaaactgccctaaaactgaaaactgcatttaaagcagaccc<br>aataattataattatgcttcagttaaggattaaccattaatctaacagattctgcgggacttgcttatcataacaagactttgactgtcagg<br>tcagtgctttaaatagacttctaatctgactaccaattctaaaggacaggctatcttttaagctaagcgttcgtgttgatcatatgatgtttt |

FIG. 7B-74

| | | |
|---|---|---|
| | 885 | atttcttttactgggatgaaagctatgctcctccatgcaagttctaaataactatcaaaaagtcctcaacaaagattaaattgagcaatat<br>tcacggatatttgactatttcaattatgtaagtgtcacattactgattctgctgaaagcctataaaaagcaaatcagtaacaattcaagtta<br>ataaggcaaaatataatgtcaaaacagacagcaaagcattgtcaaattgcaagttgcaatatctcaagggttgcaactactctgtaattc<br>agtggagataagaattattacgcctcttcaaatagctccaaattgacaataactaaataagggtttatattaaggctccatctgtaaagtatta<br>tatgacaaacagctctgctccttatttgacaattaacctgactaacgttaaaggcagtccacttgcaaaaaga |
| Contig47_<br>gene_306 | | |
| Contig47_<br>gene_309 | 886 | atgaataagaaacttaaaataatcctttatatttattggctttaataatcattattgcaggaattagcctttggtatttgatggattattctcc<br>tgcaagtgcagatgctaattctcttattatgaacatcagaggtttcagtaagtaaaataaacaatgattgttcttagatggtcctgaaatg<br>atagcgctgtcatattttatcctggtgcaaagatagaatacactgcatatctgccttttattaatcaatctgtctgcagatgtgtagatgctt<br>ttagttgaaatgccttttaattagcattcttgaacaaacagtgcagatgaaataattaataatgcttcctataattattctaattggtatat<br>tggaggacattccttaggaggagtcatgctcgtgcttccgctattgatccagaaaccagacttcattttgataaatcaaagagtgatactccttgcagcttatcctg<br>cagatagttagagaatggttctgtgcttccattatgatccaatgataagtcctaaatagtcctaaataaggaatcttatgatgcaaagaaatatatg<br>ccaagcaattcactgaatatgtgataaaaaagtgaatcatgcccagttgctctctlatgcaatcaaactgaagtgagagtagccactattc<br>cgcataccagcaagaaaatgaaaccattaaagatattctttttatacatcaatggttcttaa |
| Contig47_<br>gene_348 | 887 | atgaaactaaaatctaaaatcattttgtcaactgtaatattgctgttgtaatagttttatctgctttattatgtcaacatggcaatga<br>aactcatataagttctaatattgcagatactttacaaaatggcgatgaaatcgttgtcaagcttgtggataaggataataagcctttgtaaata<br>agaccattagcttaaacttaaagatgaaaggcaaggcaatgccgttagctatgatcttcttactaatgacaaaggtgaagtatattataat<br>gtcaatttgactgaagaaaatatgtatttccgcagattatgctgtgagaaacattattggctcatcaagttaaataagtctgttgaagttaa<br>aaaagatgttaaaactgcaaatctcagtctctacagatacgactaaaaccgctaaaaacaagaccctatacagatttgcaggaagactatgagactg<br>gacgttatgacgaagacgaaatcctatctatagtctataatgtctacctccgaggccaatatgagcctgaatctatgaatgctattggtct<br>gcaaatggtccaatcagtgaaagaagaattggttaa |
| Contig47_<br>gene_349 | 888 | atgattattaaaattattctaatgaacctactgatgaagcaaaggtagattcaagttttatatgatgtcaattaattggagaaaacgattagg<br>aactgtacaccttcatggcccattggaaatgaggaatcagacattaagatagcttatctaatcggcatgcatcctttggagagcaaggcacata<br>gggcttattgatacagttcttgataagggatgggatttgaattattcatattcatataaatgttataggagaactgtgatgagca<br>actgaaggtcgtatgatgatggccagcttcttgctcaggagttgtagccgcttagcaattttctattgtgataggggatacgattcttttagacattcatag<br>caataggggtctaggagtcctgaacttatgaaactaagcaattcctatttgcctccaggcttttgatgaagaatctagtaaattatgaatgtat<br>tgcttctaagatagatgaattggttattatgctcctgaatatagaacaagtcctgaattattacagttcctgttcaaaagagtgaattcct<br>acactagttatgagacctattcctatgagccaattgagctcacttatgaattgagtgaaaattagtggatgctgttgacagtttgactttga<br>ttga |
| | | gtgcttgttttagcttttgcaataataattctaggatattcctcctggaaacaatcaaacagcaggtgttaagctaaatgattccaataa<br>gattatattaatcatcttatccggcccattcgagaactcagagttggaaactccgattcagagatttaagatagcagccgttaaattcagttttattaggtcaaaatgaat<br>tagtagctagagcttctcgggccagcttgttgataccggtcctgctaaaaacagctctttaaatattgctattatattataagataaatgcaaattataatactga<br>cataagctttgtttgatacggcctcctgctaaaacagctcttgctcaggagttgtgcacctcatataattaatgagattatgacttgttttagacattcaca<br>tgatgaggcagaatgatgggcagcttcttgctcaggagttgtgcacctcatataattaatgagattatgacttgttttagacattcaca<br>gcaataagggaacttgttgaggaactgttgttattattattcccagctgatcagtcagtcaagcctgatatacaacctatgattttgattgataaaatggttgatttggttgataatttgagtttaaat<br>ttagataagatgccagagcttgttattatttccagctgatcagtcaagcctcctatataacctatgattttgattgataaattggttgatttggttgataatttgagtttaaat<br>agttaattatgaaacattctcatatgaggacattaatacaacctatgattttgattgataaattggttgatttggttgataatttgagtttaaat<br>ga |

FIG. 7B-75

| | | |
|---|---|---|
| Contig47_gene_353 | 889 | atggaattgaatgatgaataatatttaaagttgcactgattactgcattgtcgaatgattggatgctagctttgctcttatattgaacc<br>aaggagataacaatcaatgaaattacaagaaacatattgtgagacagtttctgtctctgtgtttgtagagtcgttgagatgctcaagcg<br>gaagctcctgctttctgagctaaatgacggaacagtaaaataaatgtcattgttttcgaatcgtttagtggagcttaaagatgctgaaac<br>gacttaaatgatttttaaagtcataatataaagttgtaggcagcataacagaatataagtcttctatgaattgattttagctaattccaattc<br>aattaaattggaatcttag |
| Contig47_gene_356 | 890 | atgaaaaattatttcgacataaaagacaaagtagcagttgcttcttccgattagttgtaaccgtgcttcttccgattaggttgcaaattgcacaagcttacgcaagcca<br>agttgctaaattagcttttattcgcaagaagagaagattacaagaaaacgtaaaagaaatcgaagacaaattggtactgaagtaatgtacg<br>ctgttacagatgtcggagattatgacagcattaccgtcaaaaagtaatggacgcatatgaagaattgacattctcgtaaacgcagcg<br>ggtatggtaacacacaaaatggttgtagaccaatccaacgaagaatgggcaagacacatccacatcgacttaacagtgtatactacatgtgtaa<br>agctgttgagaaatcatgattgaacaagaatacggtaaaatcatcaacatcggttccatccacagtagagttatctccctgcgaggtatca<br>gcgcatactcctctgcaaaagtgcagtaactgttgactcccattgaaatgacgattcatgatctcattgcagcatactgtccagcagattagg<br>taaacctggtgaattagacggacttgcaatctcacttagcatctgacgcatctgacgcatcccagctctgtaccgtcaattaatctgtgttgacggtgatgga<br>ctgctatata |
| Contig47_gene_375 | 891 | ttgactttcaacaacctagaataaacattaaagattgcatgtaatattgtagtgttacagtattgctttatctatttagctgtaagtgc<br>agctccaagcccagattttatgctctgggtataa |
| Contig47_gene_380 | 892 | atgataagcatctctgcaataagtgctgcagatgactcatcaatagctactgacgattcaaacaagataatcaatgataataacaatcaggacat<br>tgtattagaagaaatgaccctcaacaatatagctttagaagacaagaattataaaattgaaaagccacagttaggaaaatagccaggca<br>atttaccgatttaaattatctaataatatgaggatgaaaccaccccgcatacattaaatgcatccaaaataacagagtcttccatattacttcagaaaa<br>ggcataagaatcgatcgtccctaatcattcacgaggtagatcagattatgtggcgcaattatgtgggagatgacgaatttgaaggtacagctgaaatttgaaggtacagctgacaaagctt<br>tgttaccctaaaaacatcatttcacgaggtagatcagattatgtggcgcaattatgtgggagatgacgaatttgaaggtacagctgacaaacaatagctaaagat<br>acttacttacaacagccactaaatatgccgtgcgtccgttctgggagaaatgagaggcctggaaatttgaaggtacagctgacaaacaatagctaaagat<br>gaattataataaaactctaattctcatctccaataaagcgaatgtagtgaaaatggagaggcctggaaatggcgagcggagaagtggtgcagt<br>ttactggtatgccaataatgcaataaccacccatatgaaccatttcactgcaacactgccaatagtgcagagttctggcgtccatcacttggaagataacggaaccataagc<br>atgggatcatatgcaatgcaatacaccacccatatcagccatttcactgcaacactgccaatagtgcagagttctgggcgtggagtatatccagaggaggaggagctattttttgtcatggcgaaatgg<br>aataactgtgagtttaataataatataagccatagtgcaaaacctgaaaacagtgcaaaacctgaaagcggtaaagaggaggagcaa<br>taagataagcaactgctctttatgaaaacagtgcaaaacctgaaagcggtaaagaggaggagcaa |
| Contig47_gene_381 | 893 | atgaaattcaaaaatatattttattctgctaatagctcttattgcataatcagttgctctgcatctgatgcaaatgacctat<br>tagccaagacaatactcaaggactagtttagaagaaacaatcaggatctttcgataactaagaccacaatagtggaatcaagcaccaata<br>aagaaattagcctagaagacaacaaagttatttctaaggaaaatcaggatcttaaagatgaagaaacagactcattcaccaatctaaat<br>aatctaataaaacatagacaacccaacaaccatacaacatcccacattagcctaaattgcgattatgtcctcttggaagaggactgcacctacattgacactga<br>atattaagttcctcaaatcttacaacatcccacattgaagtgataaaaaccacaaatatagaaggatcctcattctggctcttaaatcagaccataaac<br>taatgttgaaaattccaatgaaatcacatttgaagtgataaaaaccacaaatatagaaggatcctcattctggctcttaaatcagaccataaac<br>aataacagcaatagtgaaatcacatttagatagcaattaccacattaattccagcgcagaatcttcatcactgcagacaactgtgaccattacaaacgtca<br>cttaaagctgaatgaaacgcattacaaggaggcattgatgaagacgaatcttcatcactgcagacaactgtgaccattacaaacgtca<br>atttgcaaatgaaatctgacaaggaggagcatcgacatctaacagattattatagcaatgacaagggatgacgacaaggaggatgacgacaaggcaccatatggca<br>acatctggagaacgaagccaaaaggaggggcaatgttttcatacggcggagccaccataaaactgcaattt<br>cattggaaacgaagccaaaaggaggggcaatgttttcatacggcggagccaccataaaagatggttgca |

FIG. 7B-76

| | | |
|---|---|---|
| Contig47_gene_382 | 894 | ttgtacatctcagagatagagattaatcaaacacactgaaggcaataaatatctaaacaattccctaaagcaatacacgataactggtttggaaacactctgctgaactatgtgaggtgccatatgaggctgcacaaattggatattcctaaatggagaagcaccaggtctcactggagaatccgatcagcttgaaatcacattaccctatcctcttcaataagaacaataagcaactatgatgataaagcttccattcaatctaacagcacatgcagagcatgcaaatataacatcagacatgcaaatatgattcagaattcgaaataattacactcatgatgatagactttaagaggacaatgtgagagaataatcggaaatattgcaaatattgaaataatagcggaaattacatcatgatgatagactttaagaggatgaaccaactcatcaacaacagcctaatcattaatgaacacgattaaactcctcacgactttcaatataaaatggagacaatgtatcaatgtcaaccgcagctaatcattcctatataacgaaatgatgaggacacctgacgaggagacatactgagaggagctgacggacctgattcaaagcaattccaaacaacagcgatataatgaggcgccattctctggaaggaccatgaatgaaccaacacattcaaaaacaaacagcgcattgaatggggtgccatcaccataa |
| Contig47_gene_383 | 895 | atgatctgctatgcagataatctaagcatgatgaaagcaacattgcatccgacgacaattgaggcgccattctctggaaggagaataggaagaatataaaacaacacattcaaaaacaacacgccctcgaagaggagggctatcagcataagagagatagagagataataacaacacattcacaacacacacgcatcatcctcacagagaggagccatcagcataactagtgagagataataacaacacattcacaacacacgcgatatagcggaggagaatactttgctatgataataacaatcaacaatacaatgaaagcaacaatgcatcctacgatggaggcactttacgtcagcatgattatgcaatgataataacaataatgcaaatgcatcctacatctgaggagcaatctactgggatagataaggaataataagcctaaacaatatcaaatcaatcaacaaccatcgcagaacctcttctcaaatcttaactataacatcatcttaaaacaataagaatcatcttcgaatgttcaacggaacaattggttttaaagaacagtgcaagcaattataattgaatgcctttgaaagctcccaaatctatttaattaaattatcctatgacggaatattgataagtgaacgaattatcaattccctaataacagacaccaagctaaacttaagtgcagaaagggagcaatagaaggctagaagcataactctacagacaatctaacaacaaggagagagagagataccaataagaggagcaataagataagtgatacaagcatatactaaatctaacacaggagag |
| Contig47_gene_391 | 896 | atggataaaaaaatgacagtttatgttgcctgcttctctgtgtaggctcatatcttaatcttgaacctgccaggcatataagctatcatgaggtcaatctcactgacatctgcgttgcaagtcccgtcaaagtccgatgagtgatctcatatacagacaacttaaacattcactactatccgattatgaaaacgatcttaacattacaagttttatgatgtggctccggaatcttcgtctcaaggcatctgaaatggacaatcttaaaaaggagttttaggtacgaaaaggaagtgcaggcaatctcatttattataaaacaatcgcggaacttacacaatgtatgttgaagatagaatgtccataattatatttgcttcccgctaaggacttaacaatttcactaatgtatatttcactgcttagaggctagaaggctatgttggtaaatgaaactgatattgatagtttgactcaagctatgcttaa |
| Contig49_gene_3 | 897 | atggataagaaggacatcataatcatatactcgttctcatataatcatcactattggcattggcctcataatcatcaagtaactgaccaggcactgacctatatcgcactgtaaaggtatctcctagctttcgctgatgtccactctcaagcaaccttacaaggaaaacgtcagcgaaaacatgtatattgtaaacgactaccaaaacgacattcaaataatctcattcaaatatgaagatgctctaagtgaccttatcgaggacgctaccaatatctcaagaggagagtgcatataagttcggtgcagagagatcattagaagatatccaatcataccgtatgcacaataagatgatgcagctatattgcattgcttttcacctacctaaggacttaagataagtgccacaatacagaggacaatataatgcttgtaactcatgacaatcactatgctcgcatattatctcagcacaagtatattgatagtttgactcaagctatgcttaa |
| Contig49_gene_4 | 898 | Atgacatctgagattatgatttaacaccaactgcagtgttttagcggcggacagtgcagttacaataagcgatataaaacttatgatggagcaataaattattttaccttagcaataaacctccaatggagcattaatatatcttgcagatttgtagatattccaatagaacatcattaaggatttagaagaaagattgatgaaaagaattaagccttataagaaataagatgaattgcatcagatatttgaattttaaattcaaggtctactttaagttccaagacaattattttaattcaagaagaattgtcttatgtagatttgtgatttaaattggtttaaagataacttctgatttgtatattggtctttaggcgatttttaaagatgaggttcaatcacagattgattgtatgaagataaatattga |

FIG. 7B-77

| | | |
|---|---|---|
| Contig49_gene_12 | 899 | ttagtttagcacttccagatgattgcaatgtgtttggatgaagagatttatatcggatgaagaaatttgtttatctgtaatatgtttttaatg<br>ccttttattggcatagcatatctggctttgagaagatgaaatgtttcctcatttattcatttaagataaatattgtatgtgaagaatt<br>tctttaaggagtgttgaattggatcaataggggatgagaagttatattaaaggcattagctcaagatgatgtaataatacctttaaatt<br>ctattgattcaaaaaccgaaaggcattggaagatttttttatagagttaaaaattttttattaattaattgaatattgtattaaatctaat<br>gaggatattagtgatgttgaagagaatgaaaattctttagaaaacatatctgatatgaattctgatgaaaagttagaaatatttttattggttt<br>tatagaatgtttgaaagcaaacagaagaaaccaatttagactcaattctgtttgcaaaaggagaattaa |
| Contig49_gene_25 | 900 | atgggcttaagagattaaaagacttttttcatcagataatgatataatgaagatgaagaaaaaataaatctggtgaagaaactttt<br>ttatgaggaatctgatgaaaaggctttttatacagaatatgatgatagtgcttatttagataataattctgatgattcttttaacaatggtt<br>ctgatgactatctttgatgattgttaaagaggatttaaaagcagttctgatgataatttatcttaaataatggttttgaagaggattca<br>tttgttctgatgatgatttgacctaaataaccaaccgtcctcaatagaaacttcaattattttaatatatcaatatagccaccaaaatga<br>aatcaatctgactcagacattgtcttgatgacaagaaatcacgcatcttaatgttaggagaacataagattcaccaaaacaatagcttacaattgacg<br>gcaatgacgtacaattgacgctcaaaagaatacacgcattcaattacttgaatatgtggatatgataatcttcaattgacaattgacg<br>tattctaacgaggatgagagggccataacatagcatagcaatcaccacgtttaaagttcacaaatagagaatgccacttcatatccaatgatgcaggagaga<br>tgaatgaggggacttaaagatctgagttccaattttgaatataactctctcaagtctttgagggggaatatatgtcctcttgacatgattatcgaagagtccct<br>gaaattgccatttcatgtcttaaaacaatatctctcttcaggagggaatatgcaatgtctgagtttgaaggcaaagtcggcacttggaggagttatagtgcgcaagattaggatacacg |
| Contig49_gene_29 | 901 | atgaggaaaagatcctttccaccatttgacagtgatgagatgattaattgtgattactaacaagattcaagtttgctcaaagtttgataatattaactacgc<br>taatgatgatttgacagtgttaagtaacagatatgataattgtgaaaaaagctgaacaataaagctcaaaatcctgaaatcaaatgcttaagcaataaga<br>aacaaccaatactgttaagtaacaatagctaacacagacaatgtgaaagcagcagcgctgcaaacagacaagcaatactaaaagc<br>acaagcaaaaagcacactaaaacaaatgctacaaacactaaaagctcaaaacgctcaaaacaagcaatagtctagcactaagaa<br>agccactcaaaagcaaaactaccatagaaaatcagacttagcaaaagctcagactttagcaaaagtaagcaagcaaaaaaaaaagg<br>aaccaattacaatcagcacaaagaataatcacagctaatcacgaatctacgcaatactgactgtaaacagttgtatttgtaagcaatattccaaaacaaagtgaa<br>attaaagataagcttcattgaaaagaatcatagaaagcgcaactaaaaaagcgcaactaaagaatcataagccaacctaaaagacaacaattgaagaaaagattgac<br>acagtagccaaagcaacaattcaacagcaagcacacacaaaaaaacaaccagtcagtaatgcttaaaaatgtagtacagacaaatgttggtattta<br>gcaaagctaagcaattaaaaagtaaaagtaccagcaatctagaagcgcaaatacaaaaaccagcaaccagaattaacacaattgaagcaaatagttgac<br>agcagtaaaaaagtaaacaatccgcaacatacgacagccaagcctgatgttaaacaaatgctaagaaagccactagaagcttagattcaa<br>tactaaaaagacaatcctactgcaactaccagcacgcaactagcgaatactaacagccactaacaataacaagccagttagctagcaagcacttagattcaa |

FIG. 7B-78

| | |
|---|---|
| | aacaaagactacaagttcaaaaggaacaatcagcgttcctatcaattctgtcgggatgtcactgtaagcctt |
| Contig49_gene_40 902 | ttgcttgccattccagcaggatttgcagcagatattgaatcaaataattagatgattcaaatacagtaattgc<br>aattcaaagatacaacttagagagtaatttaaatactgcaattctgcaatttagaatgatcaaataatactaattgatatgaatttcaaataagg<br>caagatagcaatgaattcaaatgccagtgatttgaaaactagttgcaagagggaatttgaaaacgatcaaacaatccaagcctagaa<br>tattcaagcaattcactctcagacattcaaataataatatatataattcccatctagtgatcaaacacatatgctcaacaggtaggtgacgg<br>taacgtaaacatatactacttttgatgctagtgctagtgcaaacggagtatacaacctagatgctacaatctaaatctaaaataatagaa<br>ttgtagaaaacttccataataagctacgcttcaactgcatttatcacaadcaatatcctaaacttgaaaacatacaltgaaaggattaaacattcaaaa<br>tcaagaacaataatagctacgcttcaactgcatttatcacaadcaatatcctaaacttgaaaacatacaltgaaaggattaaacattcaaaa<br>tagaggaaacctaactgctagaaaacaccattttcataggtgaaaagatattggatagatcttacaacaatatttttcgaggggcaatatata<br>caccccaaaacgaaaattacactacaataatcattaactgcagcttcataaacaacactgccgaaaggtttgaggagccattgcctctgaaaatacctaacaacaataag<br>aacgtgactgtagaaactccagctttcataaacaacactgatcaaacgatgcaggggaggactattcatatcattcaccaattaa<br>aaatgtcgaattcatccatgacgttcactaaacgatgcaggggaggactattcatatcattcaccaattaa |
| Contig49_gene_43 903 | atgagattaagatatttgcaataattagttaattcttttaatattttagttccagttagtttgcagtgaaactaatctgattcaataga<br>attaaatgattagctgatttcttctctgaaatagatgattctactgaattctaataaacttagtcaagattaaagtcttaagtctaatcaga<br>attctgattctaatttaagcaatgaacaagaattatattctaataaacttagtgaaaactctctagattcacaagttcacaatgatta<br>tcaaactccttatattgtcttcaaatggagtaaggctagctgatttggaactcaatctaatcatatagacagtattgctgaataatgctgcaacta<br>gatctatgtaaactcatcctatattggtctgatgagttggaactcaatctaatcatatagacagtattgctgaataatgctgcaacta<br>ctgatttaaataatgtcttccaacgaaaacaatatctgataaaatcttcctaaacgttttaaaatccataatcaaatatatgatgtttccaatattcaacctta<br>aatgttatattaaatgcttccaacgaaaacaatatgtggataaaatcttcctaaacgcttttaaagctctataacacaataagtggtagcagcatacaac<br>ctatgcaaataaggagggcaatatatgtgctgaggagcaatattcaaccgtgcaggatttgtcacaatattcaact<br>ataacggatatggtgggctatctacaataatgcaggcttttaaagctctataaaaaaataagtggtagcagcatacaac<br>alagtctctgaaggltllggagglgcaalctataatyagctlgtgaaatgactgttcttaattctaagttctataataactcaatagacataag<br>aaacatatcaaaatcatcatatggtgctgaggagcaatattcaaccgtgcaggatttgtcacaatattcaact |
| Contig49_gene_44 904 | atgtttattggcttattattaatagttctattaatcatccctataagtttgctggtgatgcagacagttattctgcatattctgtgattctat<br>tagtttagaggatgataatctttatttagaatcaaatacagtttaaaggattctaaaattcattacaatctattgatgattgttgattg<br>gaataggacttttagatgatacaagttattctgattctgattcaactaattcagaggattaacaaatcctgattctaactaattca<br>gaagatttaactaatctagaaagttctgcaaatacagactcatcattctgaaatcaaaacaataacaaagagtctaaatgaccaaaatacaaacat<br>aaaagcttaaattatgatgagtacgcagcagactacatcaattaaacaatcagcttataaactacgacttgcaatttcagactcagacataat<br>tcgtaaatgcatcctatacaggttcaacagagaatgaagtcaagcaagtccatataagtcaatctactctgcctacaaaatctaatctcattggattg<br>tcctctgatacagaacaaatgtgtatatagctaaagggttacacagtaacagaagaatgaccatcaacaagaagatctaatctcattggaga<br>ggattccttaaatacaataattgattgcaatggtgcattcttattagtcctgacggtcttatactacagtatatagccattgctaa<br>acattcaatctcacattacaaatggacgctattccagtgagggcaatacattaacgaaatacaataacaataaagattgttaattgttatttt<br>aaaataaccgagcgaagcttcctattggttcagtgagaaggggaggcctatataacaataaagattgttcgaatctacaactgcttatt<br>tgaaataacactgcaaacgatacttcagatgcatgtgaggcgcaatataacgatatggtgagtgacaa |

FIG. 7B-79

| | | |
|---|---|---|
| Contig49_ gene_81 | 905 | atgggcatatttgataaggtcaagtcagcttttgaatctagtaaaaactttaaatatttagatgatttaattcatagcgggctgaatgagattgt<br>tttggatgatgatatcagcttaagtaaaaatgaaaaaaacaagtattctaacggcattgaaatagaaattgataatctggttattgatggaaatg<br>gccatgcaatagatgcccaaggaaatggttctatcttttatgcactggtaaaaatatcgtagtaaagaatattcattttaaaaatggaatccat<br>tccaatggaggtgcaatagaaaatcgtggggaattaactataatggattccacatttgatggaaataatgcatcccttggaggggcagtttttaa<br>cgacggccctaaactaatgatagctaaatccacaatcactggaaacatagccaaagagggcggcggagcaatatataataatgatggcgaggttt<br>atatttcagaatccatgattaacgaaaatgtctctagttttcatcagtattctggcggagcaatttataataagggcgagttgactattgaaaaa<br>tcaacactcattagaaaccatgcaagttttggcggagcaataggaaatattggtcagttaaacataatcgattccacaattagcaataatgaatc<br>cagtggtgatggcggtgcaattttaatgataatgctagcttatcaatatccaattcaatgattgaagctaatgtctcagatggattggaaggcg<br>gaggggcgatatataataaggaaggcgagcttaacattactggatctgtccttaaacaaaacgaattggtcggccaaataggaaaaggggagct<br>atatataataatggaggcaatctcaatattgcaggttcatcactttgcaatcattccataaactttttggggggagcgatatataatgatggagg<br>caagattaatattgcagaatccaaattcaatgaaaattcctctaacaggaatggcggggcaatatataatgaag |
| Contig49_ gene_96 | 906 | ttgctaattggacttgtcatctgtgcaggtgtcttttatttccaatttaactatgcaactcccacatatctgatattcaatgcaactgaagtcaa<br>tgagggaggctcatttacaggggtattgaatgatgcttatggatttccggtggtaaataagacaataacctatcataagccaggatatgaaatgg<br>ggacattggtggatgttcaaacggatgacacgggagagtttgttatagaaaatgcccaatacctgccggatgccggtgaagacaattattatggt<br>gcattcacctttgcaggggatggcaaatatcaaggatgttcctttgatggaaatataactgtaattccaaagaaataa |
| Contig49_ gene_128 | 907 | gtggtttagttgctgttgtagtgattggctctactgcattcctattaaattatgatgaaactgtaaaatacactacatataatttatccaaaac<br>atgcatgatggatttgccatctggagacaattatgaaaataccactgttaatgaagcaattcgtcaaatcaatgatacaaaccgtgatttaactg<br>ttttattctataatagtgaagacaatagtactgtagcccgggtagaattcgaatttaccataaatgattttaaagccactgctactgaacagact<br>gttgcaaacagaactgtctggtataacgaggaaaatggtacttatatggcatttttaggtaattcagttacccatgacaatataatcatcatcac<br>aaatgatgttgagatattggaacatctcatatcaagcgtgaaatttattttcctaaatgaagacggcactgtaaattccacatctgatatggtca<br>ataatcaaagcataaatgtcactggcggtacggcttcaaatggaactgatgcaagtgcatctacagctacttccaatgtttcaagctctaattcc<br>caatctacaggcaatgatggatattattggtctggacaagatcaggattatattaaggagtataccgacagcaatggcatacagcatatagaccg<br>taggaacggacctaatgaggcttatgatccaaacacccaaaggcattatactgatggtgtagaggatacagcagcttataatcaagactttaatt<br>aa |
| Contig49_ gene_152 | 908 | atggataaaaaaactctagcaattattgctattatcgttatagctcttgtagctgttggtgcttactttgcaaccagcggtggatcaagtgacaa<br>tgtagtaagaatcggtcacttgccatcagaccatgacaccgcacttttcgttgcaaaagagaagaagttgtttgaagatcaaggtctcactgttg<br>aactaactcaatttaacaatggtggagacttaatgactgctatggcaagtggagatattgatattggttatgcaggtatcacccctgtaatgtct<br>tccatttcccaaggagttcctgtaaaagttgtatccggtgctcaaattgaaggaagcgctatcgttgccaataagaacagcggcatcactaccgt<br>tgcagacttaaaaggcaagactgtagcaacccctggtgaagcaacaattcaaaacatgcttttaacctctgctttaacacaagcaggcgtatcca<br>ctgattcagttgaattcacaaccatgaaagctgctcaaatgactgacgctttaaaggcaggtcaagttgacgcaatgatcatttgggagccatat<br>tcctcaattgcagttaagaatggtgacggcgtattgattgaaaacagttctgaaatcattccaggacacccatgctgttgtgttgtagctaggga<br>agacttcatcaaggaccaccgtgactcattagacaaggtattgaaagctcatgaagaagctactaaattcactaatgaaaaccctgcagaagcgg<br>ctaagatgttacctgaagacatcgtaccagatcaagagttacaagctaaagtaatcgcagataccgttttcatttctggtttagatgctgagtac<br>aaacaaaaggtcatggacttcatggctcttgaagtgcaattaggtcttttaaaacaacctttaactgaagaacaaatctttgcagacttatag |

FIG. 7B-80

| | | |
|---|---|---|
| Contig49_gene_167 | 909 | atgaataataagacattatttatcatggtttattcatatgtctttattaccatacctatggtatcagctgcagatgctgattcaatttaat<br>tgataattcagtaattgaacaaatatcaattcacaagcaattacaacatctgatgcaagtattgatcacagttcaaatgcaatcaata<br>ctatattaattctgatgatattgttctaataacaataaaatacaaatgattccaataaatgaaactgatatattctagtaactgatatcaatttagg<br>tcaagtaagaataataaaatcaaattcaaatgctaccattcaaatgataaaaatatttaagtgcaaatgcactaactgctgatgaactgatgtacaacttcgtgactgcaatata<br>taaaaatatactaaaattcaaatgctaccattcaaatgataaaaatatttaagtgcaaatgcactaactgctgatgaactgatgtacaacttcgtgactgcaatata<br>tcattgaccagatacaaccggtaccattacttttagataaaatctatgatgaaatcatctatctgatggagaacacttggctagaccacttggctgatgctctgataatctagacacactattaataatattaatactgatctgtctccaatat<br>aataaggccattactataaatgtgaaatcatcatctgatggagaacacttggctagaccacttggctgatgctctgataatctagacacactattaataatactgatctgtctccaatat<br>tgttgttttaaatatcatccatttcattcaattgtacagctactggtatgtgtgcattatgtttatgtaatgattatacagtcacagtagtgatgcccgatacaattc<br>cctaaattatattactgcaatcaatctgcagtgatgtggtgcaatcaattgtacagctactggtatgtgtgcattatgtttatgtaatgattatacagtcacagtagtgatgcccgatacaattc<br>ctatacctatataacaacactgcagtgatgtggtcaatgtatgcatacggaaacagtttccaccttaacaaggttaacttcattaaca |
| Contig49_gene_168 | 910 | ttgttcaaggttgaaccagctcatcaaatgtgactgtcgaagcggtaaatatcacttatctgataatgagactcactgtcactgttccaat<br>cactaatgcaagcggtacagttgtaattaagataaatgaactcaaaaagacgaaagaaccgtaagcggagacaatccaacctacaatattacag<br>tagggggattagctgttggcgaatataatgtgactgtagaatacagcacaagcagcaataatgatgataaaactatcactgtaac<br>gataaggctaatatcctgatgtctactggaaatgtaactatcagaatcaaccgaactgatgtgaattgactaagaacattactgaagatggctcacat<br>cgttgatgttcctaatgtcctgtcactgcctggtgttgtaggtgactataatgttactgtagagtacaacagatgatgctaactataatgacgtcaatgctct<br>ctgtaacattcaatgttcctggcctttgtcgtcagctgcttccaatgtacgtgctgtagttcctacaaaatatccacatcttgataatgagaccattacaattagcgttaa<br>cgatttcaaggttgaaccagctgcttgttgtagtcagataaatgcaacagaagtgaacaacaactacattacagttgaagacaagcaactattgtag<br>taactgttccagacttgcacagttactgttgttgtagtcagataaatgcaacagaagtgaacaacaactacattacagttgaagacaagcaactattgtag<br>catgtgataagtaatattcctgatgtcaaccagatacaggcatcgttgttgttccaacaaatatcacatacaatgaagatgaaactatcac<br>tgtaaccgttgatgttcctaatgctacagttaaccattaagattaacgaactgatgttgaattgacta |
| Contig49_gene_172 | 911 | atgataaaaacagacaataaaggacacaataacagtcgaactcgcagatcgcagcagaaaaacggagcattcgaaggcttcctcaaacgactggcaatctatccaaa<br>aagcgatgcaaatgaggtaaacaatagccatggctgcagcagaaaaacggagcattcgaaggcttcctcaaacgactggcaatctatccaaa<br>ggacaccctttgacaactattcaaaggacaagagaagaaggaagcctattcaatatga |
| Contig49_gene_175 | 912 | atgttaaatagaaaggctttgatttttcattgattgttttattgtctatccattctgctgtttcagcttcagataatacctttaatgaggg<br>cactgggtttaaatgaagatattgctgattttaaatgctgatgattcttcagtgattctttaataatgactagttctcaatgctgttcatggtc<br>tagatgatgttctaatatatcatctgaaaatatgatttcttcatctgatgatgaaaacaagatgattagagggtttctgattcagat<br>tcaatttaaagacaatctcaatacactctcaaagtgaaaatcaagcctagtattatatttaaaggataataaaaatcaggcccttcaaacagag<br>gatctctgcaaagtacaagcctcaacgtgaataacatatgctcaattgacagataaactgggaaaggcctcattctctcttttatggccttaaacctaattcaag<br>caatcaaactaagcctcaacgtgaatacatatgctcaattgacagataaactgggaaaggcctcattctctcttttatggccttaaacctaattca<br>tatgatgcgaagatagatttctccacatatgtcttcaattcaaacatataaaactatctctcaagaaactctttctcttgtaagttatataatcaatcaa<br>tacaaagacttctccacatgtttatttcatcacacatatgtaaagctataagaaactactacagtcctaagcgatagcgccaccttaagagagaacctaaaa<br>ttcagttcaatgtttatttcatcacacatatgtaaagctataagaaactactacagtcctaagcgatagcgccaccttaagagagaacctaaaa<br>ctaggctcatatgatgtttacacatatgatgatgccaaaagacttataaattataagacacaaaaataagtctcaattaagat<br>atccgctcctggagagatgggatgctcatcaatctctatatcctgtaaatgagaatgaaagcgctgtcgcctta |
| Contig49_gene_180 | 913 | atggataataagcgatattgaattgtaattgcattgatttgaattgtcctttgcatgcttttgcttgtgacattaacgaaatgctcaat<br>ttcattgaatgtaactgaaaatataacaacaatacagatacaagcgtagacactacaagcaatgccaccctcgtatcacaagaacccaaataatg |

FIG. 7B-81

| | |
|---|---|
| Contig49_gene_181 | 914 | atctgaagttaaggacattgctaagaatgtctctgaagtatatcagagacaaataaggcagttgccgattctgagacaccttgcataaacag acttcacagtttcagaaaacgaaaccggtcaaatgagggcatgaacctatgtgatgtattatactgaaaatgatgtcctataaa agttcaaaagatagattag |
| Contig49_gene_182 | 915 | atggattcgagcgattaataagaatatagacactaatttagaaaataacttaacacagattcaaacacaatttagacagtaatttaaactc taatttaacagcaattaaacagcaatacagatataattccaccagaattagactaagcactcaaataaatttcaaagccctaagctctaa atgatggatcttattccaatctaacaaatctaaactttatacaacaagtgaattccaattatcttacaccaatctacatcacatcaacga ggcatcagatttggtcattgaaaacaaccaattgaaaatgactattctgatgatgtaactacatctagcggaatctatgcatttgtgcat ccaataataatagaaataacagaatacacagatatcatctattcaagtctcaagccaataacatcaaaacattacattatggatagactt ctct tcatattcctcaaatgcctattctaaagataatgcgaaggaaatgacatatcatcaaatacaatagatcatttgttttctgactattatgcaaatgc aattacattgtcctgtgcagttgacaccactctcaaataacttcaatttgaatcaaacagcctccattaaatcagattcattgtttatggtctgcagagtatt ttgactttggaaatggtttgatgttaatattaaggaaatacaacatattgaagctagctcaaatatgtatatgccattcaattc tttaatgtattttgatgttaatattaaggaaaatacaatgacgtttcaatgtttatccaatgatttggataagtgcatatgagtcttataatcatga tataggataatacatctttttgtaatgcattcaagcattcacatattgatcacataaataggccataggtcctatagtgaatatact atatgagggattcacatgtattaagcattcatgacaataattaagtccaataaattttcatcaatggttccaatcactctcttgggagattatgcaatcagttcgatgcaagc tccagcgagaatataatgttttaaaattaagtctaatagttttgcactaatgatcttgcactacgtatttgacatctcatgtgatt tgaaaacatcattattgagataatggtgactatgtatctttgcacttatgacatctcatgttgat |
| Contig49_gene_183 | 916 | atgagttatttaataaggacatatatgaatattttattattgtctctcatcggaacttggctatgatgggttcagcaagtgccagttc tgctaattagatgattttagcaatcttgcatgtgactnnnnnnnnnnnnnnnnnnnnnnnnnnnnnnnnnnnnnnnnnnnnnnnn nnnnnnnnnnnnnnnnnnnctaattcatataatgattaagtgttggctttgaatctgctaattcatataatgattcagcacc tatttgaatctgattctaattcatatgataagttcgattttgttaattctaattctgatggtttgttaattctaatggctaattgagtt caatatttctgctcctaatgacattcaattaaatgacaaagcacctataaaaactcttaaagctttagaaaactcttcatgatgaatcttttatgttttctt tagcatgtaatgattcaataatgattaagtcaagtgaaaatagctacgatctaagtgaaaatagtcagattgaaatcttcatgatgaatcttcattagg acaatatgtttttgaaggaaactttcaataagtggatggtgaaggtttgcatagcgtttgcagagccattttataataaggggcatttatataaataatgtctat ttgtcaatgggttttgactttgactttcatcggcggaacatatggatcttagcgcggaacgaatcaaaatagggaggtcatagcctttaagattgacc ttctgaggtcatcagcatgtcttagcgcggagcattagccgcgagctaattcctgcataagggggtacattagccattaaggattgacct tctgagtgcatatcagcatgttgtctctgcctatgcaggagcgcattgagaggagcattgaaatcatgatggagaaaaatctcattaataatgtctat tagtgtgggttctgttcttgttttaatcaatatcatatgagagagcatttgcaatcatgaaactaactataaaca |
| Contig49_gene_184 | 917 | atgaaaacaagcaatgttttaatatctgatgtttaatatctgagtcagttattctatctctcagtgctgtaagtctgtctgcgcagatgatgctattgctgc agatattgatgacattgacgattcaatcgagtatctctgctagatctctgtagagaggaaggttcatgtgcatagcgaaggaggatataagactataagcgacgtctctttaata caagcaaggataagaatacattatcctcaaatatattgtagaggagatggttcatgttcatgtatgagacagtaaggtgaaccactggtgatggt agtcaatcaagcccatatgaagaccatataaaagaagcattgatgcgtctggtaatatctgtccattattgcgatgagacattaattgattattatctc caatgatgagtttttataaacgttagaaatgaccactctctattgtaaggtttaacgttagactatattagctctgatggttcagtcagtaatcttcttattacggcggagcaccgattttgtcttaggtggcggtgacaacactaagaaa aacatactataggactccgtatttgccaattcattcttatattggccaattcttattattggtgtagggtcatagtgttgcatttttcagatgattgctatggt ttgtgttttgttaaccacatccgctgaagctgtatattctataccacttcatcaattcatcattcatattctataataatgtaattgacaattgtacagaatgt ttaagaataataccaacactaacgaggttcagtatttcaatcatgtgtattaacaattaacaattcatcatattctataataatcatcagattgtgacacgttaaaacatgtacagaatgt cctgagctttctatgcttcctatttggaaatgtgttaaattggtgtattaacaattactgtacacgttaaaacatgtgacacgttacagaatgtacagaatgt tgccgtttcctattcaaccgatccaggtaattctaactactagattactgtaaatttgaaacaatacaggagtcg |

FIG. 7B-82

| | | |
|---|---|---|
| Contig49_gene_194 | 918 | atgaaatttaacaagagtttaattgcaattttttgtaattgatgttgttgctttcagttcatatctgtcattgcagcggaagatgcagaagatga<br>caatccttatcataatggtgctgtaatgaacagaacctggatctggtgaagatgatgacaatccttatcataatggtgctgtaatgaatc<br>cacaggaacctgaatctgaggatgatgacaatccttatccaccacgtgctcttatgaatccacagaacctggttcaacagatgattctcaagca<br>gcagttcatctcaagcagatagtctcttagcagctcttagcaaatatcctactgaaatccattagtagttttattaatgtcccttttccat<br>cattggacttggtactttaagagttagaagaaatag |
| Contig49_gene_208 | 919 | atggataaaaaattattatcggtgcagttgttgcacttcttgttgcacttcttgttgtgctcctcatgggaggaggcactactgaaagagg<br>tcctggagaaatcgtagttgcagcttacagtcagtgaggagaaccagaagtcgttcaatgcaggtgagttgaactattatgctgagccac<br>tcattcaaagtacccttattgaaaatgcaaaaatccctaacgtactttacgcaaagagattcgctacagactatgagattagcgatgattataagacatac<br>actgtagacttaagaaaagatgctcaaattcactgacgttctcgaagctcgacattggcactcagactacatcagcaacgcagctaaagaatctgg<br>cgcaagcttagacttatccgcttagataaggtcaagtgattacaaagtcaaattcaactccacctaaacaaatcagattccacttcttag<br>ataagatgcttacattgtattgttcctccgattcttataacaacgatcatatggtgaaaccaatcggttctgaccatacaaattgta<br>caatggacaagtcaacaagttatcttagaagaaacgaaacagggagcagtgatatctgtagctgtcacctgtaaagaaactcgtaaagaaaaacactctcttgctca<br>aacgaagctgcttcaacttagctaaaacgacgtctgtgtatcttacctagtgtacctgatacagaactgcttagctgaagagcattaaacggattaggtta<br>tcttcctatgacgtattgctcaccaattaccatggctaacaagaagcagcaattgaagagactgacgttg |
| Contig49_gene_226 | 920 | gtgaaggtgataatgtaaatataaaaactgttagtgcattagctgcattagcattgtttattgctatattgctgttgttccaatgt<br>agtgatttagctcagatgatactgaaggggaattcctgagtttcctgatgctgcttatgagtttgagttggtgtttccaatgatatatc<br>ctgaagctctttttgaccctgaagccgtactctcaacaatctgaacgacccagtgctgccatatctatatcttgcgaagttaagacatgcagtacaca<br>tataatgtgatcctcatattcgttataaacgaccaggctgctgcccatataattgggacaatattgatacaatcgtcagcatga<br>ttgggtgaaggccattccgtgagatgccgttgagcataagctgaatgagcaataacctctgtaaatcctttgccgataattccagacattttaatggaaata<br>ttaagataatgttcatctaa |
| Contig49_gene_239 | 921 | atgaataaaagcaaaaaactatgattatgctgattatgcaattcttgttcttttattgaccatggccagctaagtgccagcgaacttgaagacat<br>tcaagtcacagcatccaatgcacatcagatgccgttattgcatctgaagcaaatagtgcatcctgataatcctcaactattcacatcgaaaaagg<br>aaatgccgatgagaatattatcgacgatatatcctgcaacgcattgagcaaatacatgcagaaattggacgataagactattatcgcaactaatgaaatcattaatgaaatgggga<br>aatatcgatatgaagtgagatcgttgaggaattgagcaatcagcaagactcagagtaataccagcaagcaagagacaataaagagaactgaactatggactattccttgagcag<br>agactaccattccttgagaatttgaggcttaaaggattgacacaagcttacaaaggattgaccatcaccaatccctgaacgacgacatcatattcaaagacggcgaataacacgcgcagaacggccgaatccgcgaaccgtgcatccgcaataaggcgcgaaccggcaatcgtctcaaatcagattccagatctcatcaacatgaaatcgaatcagattccagattccttgactgctactctgttgctgtcttctgcagacagttgctgataaatcaacttacacctcaagaaaaacgcagatgcacataaggaactctacacactgactggcagcaatcatagattccagcaacaccgccgtcagacgcagacatgcagacatgaagggagcggagc<br>gcagtctatgcaaaacggcaattttgactgctctatcggttatttcaatacaagtcctgctcttgctcttgcagacatcagtttctatagtgtcgatgtaattcccc<br>aaccttttacagatgaaggatatttgggcaaaggtaattcataatgtgcacagctttctatagtgtcgatgtaattcccc |
| Contig49_gene_240 | 922 | atgacaacaactgcattcgacttcaagatagagaggaagaatagagaaatacttctacttccagcttcttgacgaatacgaaaccgagtagcagg<br>caagaacgtttcaatcgattcagcgaacttcagcggcaagctacaagcaacgtacaagcaacgatacaagctgcagatcaacctaaatattccg<br>gatactacacattgcagtcagcatcgcgaggaggaccgatgaatatgcggcagcattcgatgttgcggcaatcaaccatccagaccctaag<br>ctgaccacaagcagagacatacaagcaagccaagacaagcttactgcaacattcaagagctataaggaactcgattccaagcaa<br>gaagattaccttaccatacacggcaagagtaaacactgcaaagaagcaaacaagaagaagagtcgctacagtgttaggtaagcagtaagcagcaa |

FIG. 7B-83

| | |
|---|---|
| | cctataagtttacagcctcatttgcaggagacaggacatacaagaaagtcactaaatctgcaagctgaccataaatag |
| Contig49_gene_246 | 923 |
| Contig49_gene_248 | 924 |
| Contig55_gene_2 | 925 |
| Contig55_gene_3 | 926 |
| Contig55_gene_7 | 927 |

FIG. 7B-84

| | | |
|---|---|---|
| | | gattccaattatctctcaagttctcaggctctgtaagtcaagcattaagtcaagatggcacttccataatcgttccgatcaagcatcgtcaaggaaa<br>gtcctatacagtcaccctaaagaatgccaatggtgctgtttgtctaatcaaaagatagcctttacttaagcg |
| Contig55_<br>gene_13 | 928 | atgaacaataaatactttttaggaataattataataattgcagttttagcagtgatatttgcttttcactagattatcaaacaattattt<br>gaatgaagttccaatgatctgtaaatactaatgaaatagttcattaatcaatcaaataatgtcttcaaacaaatgtccaattgacaatat<br>ctgccgaacagtcattcccaatgcagtatagctgaggaaatagcctgcttatgaaggctacgatgaagatacactaaatgcta<br>gaaacctttaatgaagcattatgttacatcaaaggattattttgtagttatgatataaaatgatgcagaaaatctacctacaagcttgttaa<br>tgatgcattattatgatgactcacatgcgatataattgaaaaacgttccttaggaaaggattaaaagatataalatalgtttaaaaatgtta<br>aatttgaaaatcaaagatagtgcctatgattttttaa |
| Contig55_<br>gene_23 | 929 | atgctttaaatgataaatctgaactattaaaatcattaaaatcattctattttatttgctaatagtctaattacaagttttaattcagtttatgcaaa<br>ttcagataattttgatagtgctaaaagttcagattaaattcagtgattctaataatgtttatatagaaaatattgattgttcgattctattt<br>taattaatgtctattctaataaaaagattctaattaggttctaattttgtaggttctaggttcagatcctatttaaagatctaattcagat<br>tctgcatttgtagttctaattcagaagattcctatttgaagactcctaagaattctctctagcatcattatcagc<br>ttctagcaagtcaaaggttatttgaccacaagcaatctaagtgctagctaaaagacaatattcacagctaaactcactgattaaacaaa<br>atccaattgcaggtgcaaaactgtcatttgtcatttcttatcaaagacatattcacagataagaatggctagctagtctaatgtattaat<br>ctgctccgggaaatataatcagctctgacttgtcagcaagacatatgggattcaaatgctttcaagtaaagataactgataacggcaatctattctg<br>gaagctttcaatatcaagctttcagcaagacatatgggattcaaatgctttcaagtaaagataactgataacggcaatctattctg<br>atataaggtggcttaaagctttaaacaagtatatagcaatacaaattccaataatattattgaagctctcaaaatcttataattga<br>aaatatattaaactcatctgtatataaagaatttctgttctttatgaataataatattccaaaat<br>tctctctgtcttaaatgggaacaaaggaaacattaaaagaattctgttctttatgcatatgcaggactgctgataattcacagccccttcccatt |
| Contig55_<br>gene_40 | 930 | atgaaaaaataattcttggaacatgtatctgtattcttgttgttagtgtcgagaactgtcgataatcagcccttcccatt<br>gcaaccattaggcaatagtggtttccgagatggcaagccataatttcaaattttgagttactgaaaaccttacaaacctgttgaaa<br>atgatccgactatgtttgtagaaaagtatgaagaacaatgtgtcttttatttatgccgatgatgaaatgactgcgtatttagagattgtt<br>gaaaggatgcaaaaatatcgnaaaattccctggactcctaa |
| Contig55_<br>gene_45 | 931 | atgaaaattaatttaaaagagttatttgattttgatttgcattcctcagcaagtatcatttcagcatatagtattgattc<br>tatggaaatcaaggaggatgcattcaacaggaagcgattgaagataagaacttatgtgggagaatacactggagcag<br>atgttcttatacagattatttattcccgtgcacagttaaacctgaatcaaaacttgttgattcttaggtgcattgaa<br>gttcctagtgcaaatgcattcattaaatatatcagacccctgctgagatctatatgattctgatgatctattcaaggatgtatc<br>cttaatcaatccatagcggagaacaaactttgagactttatgtctatgttcatcatcaagttcctcatcaagcggaagtt<br>ctagttcttcaggtgatgagtaagatacaactactccatagcggaacctctatagtatgttgaaacagtaacactgaaaattccatgctccc<br>ggctgtgatagcgttgataagatgaagcttcattctcaagtcgtgatgaggcaataagtaggggttattcccttgtgggcg<br>ttgtagcccttaa |

FIG. 7C-85

**FIG. 7C. ORFs for cell surface proteins identified from *M. ruminantium*: Amino acid sequences.**

| ORF | SEQ ID No. | Amino acid sequence |
|---|---|---|
| Contig40_ gene_34 | 45 | mvlalsiillssiaaasaedysltnakidmviqddglvfvdeaityhfyktmngvyryipinnfnmedfavdvdgayyelegndddsqi eakvylykdkdktekidpgtdvtvhykyymsdlldvkgdnavlnyyllgedwevdleeieanvhfpekkeldyelvpsgsaegkwsgdt ltitgeninagdglaliveipldefasgfsnavhndtddddidndidndkddlkdltkakqi |
| Contig40_ gene_35 | 46 | mstfilviiilgiiliiagiivalynglvtarnkvknawaqidvqlnrradlipnlvetvkgyagheksvfedvtaaraglmnangvke igeannqltntlktlfavaenypelkanenfkelqaqlaesedkiaysrqfyndtvlmynnkcqtfpsnliaglfgfkeadffeaagea rsvpkvef |
| Contig40_ gene_39 | 47 | mdnkkifvivalallaivavgsvsaldlgflggnddqdtaaedsdaktttikgiefnipdgyvkaenytldgetrssgsidykvyqegy ekgatdailfligdyptdltddmleqmnlgepktinghdgyittsneggdtftvffyaedgdlvtvtvtddtlleeiik |
| Contig40_ gene_40 | 48 | mnnkkifaiaalaiiaivavgsvsafdlnffggddkqtttlggiefnipegyeivdnytivnetlhdgddeyivnsqyyenddgdslel ytsdyqddmedyilkiltkgdektingrkgyinsedgftmfsfvddgnlgfvtvsdesileevvk |
| Contig40_ gene_41 | 49 | mnakkltilaalailaivavgsvsafdlnflggddsstttvggiefnipegyeindtytienqtrtssggneyivnqegygnsdgeell flvghydtditnemlsamkvgdektingqegfitsddvytvfsfakdgelvtvtvsdesalesiik |
| Contig40_ gene_51 | 50 | miccvlltfstvsaidmdgnltasvnhldgshsdqsafisqsessktnlnannnlrvssgdydcvetmnelsnldskdskdnnlskdkt slksdlnsidsdeyslksslssinsskkssyedgdneyenledsldsknknslssnalgagtstfgdlqtminnaqegstinldgktfi gngsfitikkaitinggsatnlarfdarnlsyifkisasnvhikncyfsystncsvyffgngssidnchfdynykhlwvavnikyfslt ncnftngktdmgstayvvadnatvkncnfinneasgteqcygaalqigasssginegyvvnctfinnrvitthsyshagalcfrpgikv ynstfinnycnrmggattlhsdgeimnctfinnsageyggaistglmadnisvnitgctfinnyapmggailikgnnvkvtnstfkenk arendggavyilgndalilnstfqsnyaknvgagilingsyvtvlnssfarnnasygagiyvigsnanlfssnftnhnvkngsvyikgi gayvyncnfasntgengaalyiegsnttlilsnftnnnvtkdggaiyvvgsnaklmasnflynnaipsesdiksglggavyikgnsnti dsssfkyntarngsaiytdgknmnlsndnfdrnqawsyvldsvikpsssyfnrsdilinltliggnnianaiyntasvndiyfynvsyi sskgkkvttsneihpvngasnsqngallyqddrednqlvnvivykdpnskstslsainkndiilnktfttgilgnvslnlsssvgkaia pgnyllyakhteddyykeidednqfeilplvdvavdivsskdiveynrtnkftvkvinngpnnatdvqvsavlpkglilvssspsvgty nsstgiwtignlnsgvnqtlaintranttgavnypvsvssyekdtneannkdnqsikipecdllidiassnhspkysdivnwtvtvknn gpddaskvvvslgnlsgneliyqkstnanfnistqtlelsklasg |
| Contig40_ gene_54 | 51 | miiaiifmynrvrnkrstpatfalwvvvwmvvlffafapkisdplagffgfsrgldlliiagfaviayagfrfyikidnlnqnmtdlvr eiairneiqldeende |

FIG. 7C-86

| | | |
|---|---|---|
| Contig40_gene_63 | 52 | mnkvqlssilalvlilflslavvsanddilninvtdtqdsvidnsngisdyfssdngiinddglssddetagsqlindsedldssddla kdsdledsketsktqdnsqknedsktrlsdssiiritdssyssyfdlskdgairegtikdgtlllignvsgkifsitkninilpisdgd tmsnclirliegsgtslsnlrivnnekvgsfylcgihiinsaghdivnltinnsqmkcygiimsnasnrrinstiitgqataipmt gssnnlfygnyietyntnmiycmygngdfypredlekshdniiannyftsrngtydsycysvclmaeaggsgtviantfnntfrpit vstpdtlvinntilnvggeagiivdgnnvtimnnistkrlegfqwnkegdvvgiftygsntrlignsidtvgtngirssgdatfisgn tintessacinltksnavvednalngigssavriytsklventtirnnnissdsegivlkgkidyslvcgniieisnpedailvgktn rnplvpqhyaifnntingivvnltdiseierndtdsglnntntsdsgnngtgntgngtnitdvngtdingtdvngtnitdingtdvngt nvtdvngtdvngtdvngtdingtgnatipvnitklstsitvnttvlrgdyldaylkdqygnpisgvsidhfkdkvyakttdsegkas lhfdaipdnytmnisftgnnylssnitidisvipvsylnesnfyeyfgedgylkgdveyadlifqgdfrnkrivlnqplriisdsav lydsiikiesdkvvvdgftlvnrnpngkqdnhrfailldyvrdvsvinnkiklsdsydsgygiylsetqdstvsnnsidvkadkltfgii lydskdnliqdniikvngtddphqyestiqvdtsisvddyeaegmiipevyktygiiilfyssndigynvinatsglkkyytavkestn sivgvdlyydsnynkvhhnnvvvsakdpylyglgvlgaetgkrdq |
| Contig40_gene_70 | 53 | mrkeiisilviaiiaisviptafsatdngivitygettynngnyksivdnyfaskgygssnvqgevitaadvnaissgisgktynsnqi vscalvdmtqnneitvevdnsittitpqmyasalksagitsghvyvstpvtatgesalagimncyeevtdveipenvkqaandqiytea aivennddvsseelsklvddvkeevqeknitdhdtivtiindysttyninisdsdienladtigqlqevqddansykeqlddavntts gfsidgilnailsifnfs |
| Contig40_gene_72 | 54 | mnkkrfklltifiafalintcfilndnlsaadnapkgysnyyirgvcfnvpdsyklvdegwddvnrlsyahfkkgnnflnisldkhst kfnknlldgfssftinginlnkktishvtgfyakkngvkafclcnrg |
| Contig40_gene_75 | 55 | mmvillitllsvpilsltidysndviinsistknelskitdsidfcyysgkgskkvvlldfnqdfsvrftnngqkgiayadlelsdnnhk eisseydyiglntniqfskgfnkilvewdedtglirlskln |
| Contig40_gene_87 | 56 | misissvsaintndssiqdngdlsiqdsideisqfdeseqlnkinkdspesnfnqelsndskdisadsnqdlmgfenydfkyntkssys nalkdsnvinvtgstfqdiqdaidrandgdilylksyfkhgngtaisinkpltiigsyeannkshyldaylksrilyidsddvtlinih fdyggnidnngnggaiyldgtncaivncsfkgnhawlggaifgsnnsndlyvggckfvennagigagittcgfnclvsncsfennsavt againtdtqkngdmtffrlenstfinnnatgggainfdgyygsvynckfidnyaknsggaiygslkpfdvslcqfynnyantgaairg tanynvsdcrfinnsahhagavfihsysnvidsyfennyaeanggaictdsntvgviikgstlignnattgsaimmvssrsiiencnfs gnigksegaiysihdcnishcifdsnqaekggafyiyrgnnsnidncrfinnsanssgaiywvnkgisnsyfeengarygsaiycs nveadsgfiitdcdfinnhpkedgsntkggailyldqlkciivanstfeynyasrggaiyvegdvniianstfkynkadifslsayndn anlivtlrgyenymnaiyaektvdfhnvtywdgefvtgdypikrnleaginiildcrgnghslnvtkmtnsmgevifdemrtlpsgtya yqvsvpdnsyytakklkpdifnvpylcenilgidvadisydqypvvnitanytgnytvyianssydvtftdqdvergrvlgynititde dvvkgekliviphlfdikdgyayvqlraidqenvelvyiqnrtsfnvykaasaleaegavavngsdielnymaqngtvtiesikkdgs llengtdynftvnddkiiitgldaghyianltlivddyhnsssidvsidvliktsidvadsisiaetesslinatlspeeagllnyqsd netvavidndgritgilkgnatifvsyagnedyspsnatvkinvy |

FIG. 7C-87

| | | |
|---|---|---|
| Contig40_gene_88 | 57 | mvslssvsaasdliqdyedltiqnsyddlliqdsfnedliqdssnteiktqdssidnlketinqtesiddtltnqdlsslqdsskenik dsnlkssrlgksltvkgntfqsiqsaidgaeagdtillsenmfkgdnyyglgeqlyinksltimgssqfgsqyllnalhssrifnita dnvtisniqftngyvvgepggaiywfgnngkiinsyfslncanssmewdieggaiyfglkfknqyienclfkynsaydggalytcsqnt tiskctfdsnfgisnnagmangaalsfsakdvyvidstflnndapegwgcavyiykhgyepyffncsfknnsaafggaicwltdggtf lnctfennhatggdaiphggaiykigrnggniinstftrnyattgsaiylnaylnidnctftdnqadsegaiyiitdnvtirnclfdkn yaynygaaifswdhdnikvensrfienharneggaiyflgkncqiygclfegnrvsnfysfggavfmeisgedtsildcsfknnsalyk ggalyisygssekiailnssfednsasnggaiqadwnlsliansssfednsasyggaiqvfgsvdlianssfednsasyggaihvfrsig lianstfknnyansleinqskesygrvftfkgkenyinaiytedyslnfenvtywdgsfvtsgspiksdceagikirivlrqgvsagpv vlnitkitnikgevvfneynglspgiyyyeayhpkdsyyesekisgmitvpkkatdntlaislddsiygedlkvnvntdvsgeyriyl ansnydaiftdddvakgnvlaydivenelkgnkwtilknslnvkngyayiqfadledgenyinihnrtsfnvykaessidanetia iegdgaevnytiengtasidnirrgsaileegtdynftvtpdkiiitgldmgnytvklktivdsnynpstkevficilgrtaidvqesv aiekdksyllsptlipedagtlryisndesivkvdskgnltaise |
| Contig40_gene_105 | 58 | mninkkitficlvlvligllisfnsisandlgtvlednngdlndlnnddfinsdvnsdsinkeaisnlksinsqdestssdsnnsaas nsnsvasssnssassnsansnsst'ssnsansnsvssnstnsnsaasnstnsnantnnsssdasktqtiklssqee salneflnaikttttkgtlvlkndlvlnqtislnnnitidgrnhsissldvtnmfktfakitlknivftnyheienlrailnsgeltvln cqfngfsyltngsaiynskkltvqgtkfnnyvnnsggaiystgtltinnssfnknhagknggaiystlnllnqsvfsnnsanesgga lysksgslnikysrfnnsaslnggalysssnstvisysnfvsnfveaydkasnggaafiyygskiaysnftsnhcktltnssqkksi qsmggalfyyggnhtlsfsnfknksvendggavriaknvgkftlnkcnftnnnasyedggaislatpnitisnsifknfanedggaid tfslgsykvnvliknclfnsntafkaagaiylgvntvqsivnsnftsnkatvagafyiesisvsisncifssnkadnvskktiynkgqk vvshsggavfvkngstvtiknslfksnkatsgaithgkmvidkcnftsnatnggalyggkstirnsifyknsatktggalfine gnvnmkssmivsntaksysvystvsitlnnnwgntlsikdkspktlgltnvkvstwlhkiraktklakgkttttlidlrynnndkl vstafnnpltltvsegtlsskkvnlkngkatvkfkktnsktavvkvkllgktarctiktk |
| Contig40_gene_119 | 59 | mnnqnkysciviagmsrrmgqdkgsmilynkpmilhilerlnhkindavilnhaerislyrnllnqyadnieenfdyelsfiedev kskgpisgvmtglkniktdyalvlpcdspfisgeyiesmfgildenpladalipfhiksnkdkfkdneefnfknademslemkignsep lhsiykkdnlnniksllddsdlyvksfirslkspvfievdnkvlfdddfknlnkqedidnlkfkk |
| Contig40_gene_141 | 60 | mgffdklknalesgnksnhdkresqkneaisdnprgdslsdknkrnslpdhqnrnssdnnvrnfkylddllhsgqkdivldcdivlads eiesykrgidiggsnitldgnghvvdgrnkaeifkvssknlaiknlriengyseldsiidvfskgehlsncsffknsneshrifgdnl vcigsiirnmgeltihhchirnnssrgqgtikntglnisdsifeynlsledggaifneglklsdsrefnhsnkrggaihnefnge tliensfdknggrksandisnrfnlvlkdmhsdlkidnewtvfiekgksfdidnkggiefaplnndeksftflkelldgndsqidlm hdikldiandeqlyfpdginfnrdnlifngnghtidalrmrniftlagndiifrnvnlengfsklsngaaismkegflkiyevefrdna aynggaisikdasvsidssifrhnaanaikfetggaiynengslsiidtlfisnsslwgegailnksgalslncdftdnrsvkngn disnydslrickcsfesdkannsnsdsgeitnsnlgskinnsnsdsgeisifnnlsklydsnfnhsilinkgllkidkdfpiksaqik nsgklkaynfndkqiegidinnedggklvfvidgvevlntveisqkwieikifisstfkdmhserdylitevfpelskwckerrillte vdlrwgitredsrsgnsinicqlyidkcrpfficflgqrrgripekgerkvteetfinfpkvsnlvghlsvtemeiehattlplfkle ndfdnehakralfflrenpfedvdlspaqrdiylnrkpeddeklsqlkdlirekciffdysciwdenmelyelsssskgglftcngrp lseviiaevkkqienefpdykpvktddifilddamlqnleimsishdfvgkqkeidyinefiesdnerllivkgaegigkntllsrvhal lnekgissimrisnataksnssnslslsigseiglfngeealykg |

FIG. 7C-88

| | | |
|---|---|---|
| Contig40_gene_155 | 61 | mevegdkmnfkefeelinsgvkeislnedisledktqapieiktdglvidgknhiidgnnklpilyikasnitlkniifkngfsedysg aitnysndlkvehcqfidnstenagdlyggaiyngensklweksifkendsdfggaifidsdstvkinnsvfelnisefdggaiynkg eliidksifnqnmafkggaifnensltindshfknnkasdgndigtenedisisnslcefinndny |
| Contig40_gene_156 | 62 | mnftefeellggeakeislyedvilesdedyrrgielkrdglvidgkghvidamerakafhiqgdnitiknlkfknavshkgnggaie nvgkelsiknshffnncslgplggaicsfedmnindcifesntsvrsdggaiyletffkpnvtvimkncsfknnyadggfkdfgsnag aifnknanlylfdcnfedngvvsaydsssesignkngiitmdnccfntreshsifnlgfllinssrfyhhpenleigsifnrgfvgll ygernqykveldgkvldssdigdlineykktyntdtkevgfifkkniiesindlssdnfnledfnlgdinlsdykddeylmdllknkid liysgdfedsdesi |
| Contig40_gene_157 | 63 | mlyyrgawadwdldnfgsrisyiddfpfnilkallsyfetgdeqsvefnaegwfytfkfssdvrvgerviyestidfandficeieer mglwaffpsrrtsdedyyelvdlivkirtelldkdlinkwidiisqs |
| Contig40_gene_158 | 64 | mgdymntdylkefeelnhttesifdlgisgliilkdgtnltswelsnpddilylsadfrckenytefsnfknakvlilqnyvrpnfg vgslffkeadlitkstwhslvafyginwdisstdslknmfanclsleyayfedwdtshirnfwgmfvaccslkaidgmenwdlssaen mesmfescmsledisflsdwdmsnvenifemfrdcyslkdasclnwkfknlkngdnlfancrklesfpswyddefinqfgirnqlnid ddsffykiaggfdpqdifiavgyirdeecklkrllrdssvhfyarraalnpnlndteileefadskdyverayaienpnftnigiirrl anndkshlvrfkaenklkseglelliedyprefkqafeghdreraslvlsqwrgydstdanfilakvisdsdeeiefsetfeayli smeekpqdpslfnwfsstavecmekrvdedigfsqlfnnmykshmnstdyatafldffqdilendrveklnllrglvdswdtdcpddan mhcayvilnikkiskdeledriakakvcipenlnsypklmafmnavleadk |
| Contig40_gene_161 | 65 | medrkakfivyvvcllaficsstvfsmtgglsdwivsnvrntnedannngyidssegqyysdsdgqyysssdsydnsnggsgfldglfs ssdnsesnyyssdeepdflarlirefiggssttdsyydssdsnyyyedtsngydlgngfsydlneliftktdnklnglfn |
| Contig40_gene_163 | 66 | mnilingtgaigiglgasmisqganvsffareetanairkngikrtgifnhysfgpesfkvytdykdipdnefdfvlvssktianddis rklnehksilkedakiiiifqngfandepylrffpkeqvycarvitgfkrperyisevtvhtepillgslqkdddgefidsrpvsiiskm indsgipsetteeldkflwakmlyncslnplgailngnygklmeneysvkimnelideifevikasgyrtnwdspeeyrevfysklvpd tynhrsstlqdiskrqkteidtlngkvielgekygvdvsvnktiyniiktiesef |
| Contig40_gene_164 | 67 | miivtticvlililvlfyglfpgltnsndnsdnnliiqnqtshftidiengtylsgegksmvdsnystlesyenftisgyeayeield ngswyivslykvdyntpssdwvynsdvdedgnayiffnskgeyygyfinipsssdpstfenlsfltsifhynh |
| Contig40_gene_165 | 68 | msdvgktvittiitlvttafglvaglawndaiqklidsvmgpgdaltgftyavivtilavvvtiilariaakmgvelee |
| Contig40_gene_169 | 69 | mksdkrakfaiffsiailalglsniaavwtgdllisgslpvinetdkliadndnfspaslntvyeekkvvevvndtsdandtstpnna dsntesddtsnsnnnnnnqnsngngnqntnpnnaepssggsagtetee |
| Contig40_gene_179 | 70 | mingimdkqkvitafgiilflaaafspfvvlpilgv |
| Contig40_gene_187 | 71 | mfnkkmvlaisllavifasmcivsaddsgegsfkelaklvsgr |

FIG. 7C-89

| | |
|---|---|
| Contig40_gene_203 | 72 | mktnlkktiiilalimailiilsigaisandltsadsnvdmndlntnldsndiliansnsnsidaeideanysngradakeklkesnsli
enentegntqiedensspnktdtsisietnsiergsdltiylkdingtgianeklsiqiinktytrttdskgsalfkinlasgkypia
isyngsedyesssddfnisvspmktkinmlsnsivngrkltielldknnnplkykkisilnklynlttgkdgkvslninlnpgkfpi
qitfsgdanyhtvskssaidvyklkssftvpktsiikgkylvylkdsegkaipsakvafkingvsstkttdkngrisqkiglkvgnyt
vqlnyngdkshlkkvqsfkirscnsktkftvanytvvrgkylsvylkdsenanlankkvtftylkksytkttdsngkaslkmteagttt
vnlqfkgtgpylkssanvkikvlknttadiiaknqtrhlngsstiryyvkltdnngnpienetielkvrcnnittgsgnkitkktivls
sdniinksedkkllnemakiilrakgykvivsgignphysdvrdysnvcvfslvggvdsgmfvdmshsyyknylkkyknqfvlgcvapp
vylnlgnmtwlkrahdddyspksfkglyyppgkyfntvtkldyvygdgaeelvnnflnyakkgksidlgqsvpkttytyklttdkngnay
vdlqvgtytissssilgnnykvdtqtskvnvik |
| Contig40_gene_221 | 73 | msivsandlnsiddsieadnlnsieledigvdsvesddleksnidekvlsdgesdgdsqnetetlssqdennesdvssrpnegvatnle
ldndadkenvkigelvtwtleaknygpydaentqvydelpegleyvshtvtkgefnpetgiwkigdlkvgekeylkivtkavttgekvn
kanltsdtdiidpdecyeeeidveddddnhfekvihskqlprvgnpifllilslltvlglntrkk |
| Contig40_gene_228 | 74 | mnskgkylvlfililsfsiliisasfaytgtgfshdipfskyssqsnsdilnkynntdchseikgictyvadgdtidvegvgrvrfvgvn
tpergvtayicskrfvqkfclnkevsldvddsrkndrygrtlavvivdgknlnemllkeglaeimyippsefypydwssdsttsssyts
gsssnsggsysssssftsgstvsapyvgsanshkfhystckwgkkisdknrvtfnsrsdaisqgyapckacqp |
| Contig40_gene_231 | 75 | mkknlslknililslliflvlsigssfatedinttgdnnliddnamadtlsdekeisyqkplmsdensnsnngsdeekvissnskses
fliirpnessitvlggnfqdlqdaidyasdnytiylicnmlgegkpiivnksvviegnghtldanyssrifcilsdnvvlknlelihgy
qraydsyklrpydsknfdnapaltqefidysvpplnstddieygwgpaikwlgnngtlidsailnnkidyandigegkavswlgtggri
intfmvsneyhhffvpwgivgyqqksegkvldtsphgvyygniegnvyfldvalnvlpnldvknvtsyygeqkisfnlnhgnasfvne
slelsilskkynytfnvfsdengnfefnlpknlsvgsynlivgfndgknniissnttvkinkatvsvsapdfkaqysgakytlklinak
tkkpisgmkvnlnvyngekvrktytvktnkgiatfdkftlpsviydagkhkvtisvdksydlskkeftvqiskaktdiklsktsfkykk
sdnlkisiknqikktaisglklkvvytgkkyktyltkdkngmvkintkilskgshkigitsedkrylvsktsikva |
| Contig40_gene_232 | 76 | mkrniyfillvtlfliismsvvsaandadvsyiddeivsdeylelsdsemgisdidyddiesdmleneikenglsdnndvlksnlpene
fkesnyneyyedimnsnsqkygefinflinnksfefrenslsedgyflyatknytlrlwdgvnytilkddyfastaeksgyfvnesfy
ddiiyyheynynyldeeflgwlmwnanykkvfvsgsiedkvdissvnpekggspksgnlpssydlrdygfvtpvkdgntancwafatm
aaleshlktentsytlspqwdfsennlknvmsslgrngtdklvnsgnmlnslaylirwsgpinesddpynsnytnisedvyplkhvq
gvkfipnrqnylndyikessvlengavyismywdsffekndayyfyngsgynfnsnymhavtivgwddnypknnfligsegmgngafii
knswgtnagnngyyvsyydqmlgfdntyagfaftnvenvtnydynynynplgftnvfpvnstsakfanqwaalksgtlksfglyvvsp
sictanlivngisigntssylsagfhtilfngaayvnvgqtfrveitlqhigsshtyipleerienysnvvsgyngsflwlrkngvdq
wvdlktevdnaniclhvyteciegllethvrsnnlvtyfntsslnatlvdgsgnpiankliyfkllnvtynrttdsngkvslpihlnpg
sykflisflgdsiyhksnrlvnvkvnkmhtningnvstvhqgeylgllikdsngkalsgqkvafcllsvtynrttdsagkakllirlnp
rkytftlkffgtagyyacnktfnltvlsaksgsyemgiddydgknideniiinnetfessdvvndnimyndtqyniinedkgyyn
nhsndinfellldndqnyiysdlnllellnndqndicfdlnlleyidfdktdyyndnlynlehymkdsltenedlyicenklnihdlnq
ikiggi |
| Contig40_gene_248 | 77 | mkkmemasyiiliasvlailyalifnpadwivyaiaivcipflvlsfglltmskpikeeeerreepftgy |
| Contig40_gene_251 | 78 | mpkiaklwnkladpkniprlfavilglliiagflipmglntdqiytrpapqsqmdaglplapydrggevlespgiteaqypenaenlgw
insymtpiaemlkgispyfgtsicsspgglideilyytrgfdtilessilmmafiiaswlainftmdrtkderdiaedvkraiassdrl |

FIG. 7C-90

| | | |
|---|---|---|
| Contig40_gene_252 | 79 | aneveesnrkarekqakkefr |
| Contig40_gene_260 | 80 | mfnlaiwvylglalaifgslatwpgvkdpvirtintevasvgvslillcynstlalltliattliivtlilfraisrleeigadv |
| Contig40_gene_261 | 81 | mfaivslsavsasddfsssladdsdsdilaiddiaqkdsshklmdeedisvefeiddgdddtsydsyyddspgddwsnyedypelise<br>dailtkievlnvpshygddnisfrlidlntglpipdvnlglqdsydydvysfftdedgvvvypipvkvgdfsivigfyedmvvneldd<br>mvcnftklnvsiptvpasikitktgtyyndtvlkvslvssvkevlsnqkinltfsngkkatvktnskqianyalkfapgnysvtaalvs<br>dgiveanksslknikilikapgtlsptalsttyasgkyfqiklntsktkkaiggvklnlkvytgkkyktvtvttgsngiakfsastlsvg<br>thkvivtvkdtkyvsassktssikiskasraisapkvtakyksssftfkvtvknkasskkilsgvqvslkvytgkkfktynvktnskgvas<br>fntksltkanhkvivnikasanynaasatsyinik |
| Contig40_gene_261 | 81 | meenpidfkdnsinskalkdsdyehasdelsqdlynriinakeneiiliepgtyikhkvhltknitlqgtgdpreviidgeqlgsvffi<br>ndinvtaqfynltiinglsdnfggicietgntyvdncifinntalnitnggaisnygnetnrsylfinnslfignhadhdggavttcy<br>aisdiynsvfinnsavrdggairvsvygygnvqdcifignhadewagayyswagnssidrcilfnntagtnggavmvsgslnltnsliv<br>nntggetggsfyiqqpmfdaktvinvnnniitnnssplgkeifvkwnatqilfpnfnnndwgdedptgpdvvdpnnvsdriipertkri<br>tvlydklnwglldrytdvlddyygkssssdskansdtktnssglkfdtenktnddskeeggslnnsngfallnhnnssssnstagggl<br>ekkdnstfvspkdygkmvelfednpsaskstdiryfavlafilivflvglarkrk |
| Contig40_gene_269 | 82 | mkrrykvlflailtiisinaisaseigladdnnaidendgfkikqdimsekiisdnedadsnnandvntdssdevnednvieqntdtdt<br>vdedeedpiipvdtrlfnpdsvikgndlnivlkdidnnplangtikfninkdqyqrttdktgtaklkinlspkthtffieydgcdeyyp<br>tnlvfdlkvikpvqtklsvkstivyknnklmvylktsdnkalanqkikiglpkktytrttdknglaslninlnpktysinlsydgkgky<br>lptskkikihvfenellgstyygkvellkgignsskvkiayvvglhvlehqihdevynimkqktsmhysynvykitltkksgnyntdr<br>mrgqilaknyivphvnkqkynlvdvhsttgvyykksyfihvpqnrhkpslnlankaikiintldkqskivwspdsqtsppyltlpim<br>kagtptfvfetltsepvsrskyraniilinavdklfg |
| Contig40_gene_296 | 83 | mlfsviatvsatcnvivitdpsgedpngaaagsmsfannmfqssfimskddgyamlsggegngternyaiiaalaamqhgatpasaaal<br>asgfkgirlviggpsmgaaiggdynaylvvddagtikvthtggvvqlpqgskgaiihlrnsagnpmygtaervrretavnigkmird<br>gypatyivgkamkevaedsgekyggavnlvssistgdmfvpdqvnttgypmdenyskscekcgwatgfpdaerynvcpycgseltvns<br>atdvlidsitvskdsvsvysgdrlglsditrevvkasvkkygynastiagslnkginngliivgvdyvepsdlnvkpdvravgvyynp<br>lpngrsspawnlpinsmvltilgtiqtaigfvlimlvifrtrllksfkdrvs |
| Contig40_gene_297 | 84 | mfikirrdtllilllafilililcgrlliyvayassaqveegvpiagiivkqndivpidniryvensglregsyidgdilktsirelpvt<br>eaeanaekfvkrstipgttiapiagadvnvnkqtgivtvtviedfstinitgnsttstdftenepsksvynyslag |
| Contig40_gene_306 | 85 | mkavipaaglgtrflpatkaqpkemlpvydkptiqvvieesvnsgvddilivtgkgkrsiedhfdrsfelehhlktkgkedflkeieyi<br>sdladihfirqkkqkglgdaiycakkhvgndpfvvmlgdtitkdtvpctkqlidiyekyeksvialeevpdekveryigigeeiedsi<br>ykidklvekpplrvapsnlaimgryvltpdifdcienvepgyggeiqltdalskldeiyqgvfkgesydignridwlktslrfaledds<br>arddilefikeeii |

FIG. 7C-91

| | | |
|---|---|---|
| Contig40_gene_310 | 86 | mncsvyedyseniitadinsnelnsdfaygdsdseeildepsqkliktgsdnsdfkdigniidnakendvielsgtytgdslivvnks<br>ltlksssatldgeflnelmainapnvildninfinanytglsvnnnyvtigncnfdgcingelgcaliihgnnvnlnsnftnnvank<br>sschhtdgaailyligndcqidncsfinnwgynfetsssggaiwikgnnivinnsyffnnsataevgwtfhgeeityladgyggaaflvg<br>knvkiinslfdsslshaggalyyksaydcsiinstflnsfsvgeggvilylgqnidglmidscnfinntadgldgvlvkytdlgsvlya<br>skfaenvvitnssllnnkgtsavyflgnnlnisnsliennlstaviymngsmndnfwsknfdsadefkndcfiirdnesqvpdtwfnl<br>vcdgldslkakgvydynmsfvlkdasldnhaskisltnnlpnyhinlknsakninpnelvivdnqadftydyiesakdsidvyddynn<br>lilskkvlsgityindsgndtkdlqdaidsassgslislsnktyvldtillinkdihisgeenttvmlsnssdyifkisncsaanysdyg<br>iaisninfildngdivalaeavngsgslsidvasikitdnsftsregvvresitileldsqravlaptrnisisnnsleigmpfcdfnv<br>ksvingsdvrvdvggnlaskkasqiickdmvtkaiasnvdsrsgeyfnvslkdssgkplqnkfvqigfngavynrttnesgelrlqinl<br>aykgvytfaislyylgddecngsfevakitvnpqspilmannakykvssttklsasfksmkgspisgktikftvdgktysgktnsngiasv<br>kvslnkkgtykftakfagdntfaavtksakvvis |
| Contig40_gene_317 | 87 | miktdvlvigagpagssaarfaakggvdvilmdkkseigapkrcaegvskktfdkldlemdphwvtqeiagvrlvapdgtdvwldedvi<br>dlpeagyilerkvfdkhmameagregaqikiktqakglkreedgsftvtcesmgetfdinakiiigadgpeshvarwaglkayttkpkhm<br>eagvqfemcnakmeksnvlefyfgsvapggyfwlfpkgddivnaglalipdmagdksayeylvdavnncyatkdaqpvelnvggdpvgg<br>lvkemygdnimlcgdaasqvnpltggitngmuggrfagevaaeaikagdcskdflkkyedlvkeemghemqkytkvcdylwtlddddl<br>nsiahafgdmeft |
| Contig40_gene_342 | 88 | mssnslssnelnsrglnsnglnsnsinsnsnsnsngkansksdsrlllndknlkvngteekyfiklvdgngnpipyvdlifnidssiefv<br>ggtvrtdengiayifmdfsypgpytvyasfegdgnhnpsstlsstvsvykdteisslqsygylgenfsfkitscgepvsnqkvlisidn<br>knytattdseglakvklpnqgktysiscnfsnrvyyygslsknipvykraftqpncyallrkstftvtlkgadgkilsnrtlrfivdg<br>keynktnskgaasinidlergeyrinyyfntdgvygpvsnytdlnvvdpsgqykrllnvkssasakiyltggyatvtsliksstaksi<br>tkkyktnfekavaiynyvrdnldyqyyyntrkgatktlktksgnccdhanlvalcrasgiparysnskycvfgsglrsghvwaqiyvg<br>gtwysadatssrntlghienwdtktnkkdynfrnlpf. |
| Contig40_gene_344 | 89 | mgfvlissvsaidideasssssdlsdssisndylvansgddsvasssassiaaddsdlsnnasssnvnfenevlstnnnedteseivkd<br>sknqlssssslqastktkttlkgsgssvyrgnpyyvtltdsngkvlasqkvtfnilgknytrttdskgvasininlakgkyniaclyagt<br>enyassklsvaltvnlmstkintggstvkkgnaysvtltdgngkalssqkvtlnilgknytrttdskgvasiainlaagkkftltasya<br>gsanylsskvsatvtvqkgdtsikpsgtsivkgnsysftlvdgsgkglanqkvaikisgksysrttnsngvasiainlaagkkysivcs<br>yagssnykassstvslsvtnpstnsktfsiakieaaatnlkayvnknkavpttvsvggtnlkisefsylmskaivnlnsnntnaitlps<br>giyngasasnslnatvykaqvdlskrvynyidknkvpaaygtvynangaslgnagfnlytfafakildfhktnkylpnycsfdssvfk<br>asngssssnsssstnsssgssnssgsssstpavtvkatslkaastsvirgddysvtltdssgnalanqkitfalssssytrtt<br>nskgvasltlnlaggkysittsyagtsaykaskltntvtisnsssrfflndietaaenvktyvtknkalpntvtvagtqltlsqfsyvm<br>akaihninasnsnyislksvassnstgdyldttvyraqymnltnrvisfvesdkitptfatvynsngksvgkaefklytfafakilafy<br>ktnnylptyctfqssaigvvpdvatnvtinskinanmqfkvglnekntvsnlsaylvgtgqstittniknvaaqltkqlnstatkala<br>iynfvrddisysysdsrkgadgtlssgsgncvdqaslvvalcraagiparyshaqgctfssglvtghvwaqilvdgvwysadatsvrn<br>slgnivnwntnsyhsmkqyaavpf |

FIG. 7C-92

| | | |
|---|---|---|
| Contig40_gene_346 | 90 | mednllknrklililsiflvsllaisavsanedvdnglidsddsilqsaevsdsaigsdsilqsaevsdstiesdsieledkgnvlkssd nasfelddknnigsadseleddylepkeknvlsmdenawfynyivwydgddgdwvsldfvddlknpenitirlnsydtpfdgvdlavin dydysitklttddngtvvynvpyevdelsvfvgfwydgdfvatygnwesyticavnwgtwyrdpskrtydfyvsvsdmdtyespigaqv vftsdsnqyvgtideneraiipkvsygtydvkviydgycilnlsdssaiefyddhhtdpdslgderidymyvdssgvvyldlcydgslk vpdnstyepygddnpsggsgnqsggtvangtftslqslfnraaanstisltrdyvyddgfdikgivinkdltingnahtldalgksri fyvnnstvkfnnilfangnatlggaiyngsavnclfinntagdgaiyygsalvcdfinnsasrnggaiysggavncsfinnsanlgga aiydslfavnstfvgntlassnptggsattdvsvvsfnpittyipsppsmtgsigwggavldftrpvlytdynetfylltnftlqqdgf nnygnvqltgrdlvfkslypysgnysmaliisggiftptyvlgendtyeahfklnglslglhmvyayvdfgypeyysyriggymdrva ydrtaeiifpilinktveissnlnkyygtgkytvtltdggnpiananlnvslagktypiktnanggasmdinltpgtyeavctydgv sqrsniivrstinlqnltgiyqnakvnatflnaagsplantkvsfrvgsktysattnanglatanvdlaagtydviainpvnneqktsk ltiskaksislsstsnndkvtltaslspstasgnvtfnlnnknytakissgkasqtitglnegnytanayysgdsnlnsssastkvvv kiviptkiiyknmttgpvaksdgrignyfcvklvdgsnnaltglp |
| Contig40_gene_349 | 91 | mnrkilvllvlliavgftmgpacaasttikvgnykdvgkgdristfnvpkdqaylkgvyavifyhgkngddfrphtyvlskikvyyk nkkgkivtrsstaknlsglsilstkqvsgytpykmdvsyrkmtnaekkkicgslvy |
| Contig40_gene_352 | 92 | mkksvfkilialalillavsivssndlsdsnvssdltvdsdsissddtgssddtssddsnqddvsqdktndkklsdsqsdsskdtqdtdd nntdngsdkcnliitkkgnekvkvgdtvewtievknslntaenisvdeflpqnfefksakaskgnyavelanwdignlkenesatlvik aqalkagnftnvanlttdsdningkvlsakadvevlsenkknetpvgpkknkdnnstvkkihkliknqtnntnmtpidfkksgnslfav iiaalavlgiflgrrrin |
| Contig40_gene_359 | 93 | mdlsdsccdtlisdgsdgiillggsddislsdennnlnfdlndnpdfnldydsnsypnlnsnsnsksssntygndftlsrfksvltss ynlnggsfediqsainhaadgddiilngtftttgsvivinktltiigspnavldakniskiflveadgvnlknltfingksrnesdngp yggtvnwqgsngtivncsfinnsgdeksygasilwkgsygkisdsifknsysganggaifalgenltinnsefinnhgkeggaiyfggs samwiinsifinnsadsggalaacamnrqvinskfignsannggsiswcgsnglisnstfinnsadqkggsilftgtnnlvkgsvfins saniggainslnrlnyindlrfennnaslgedcygdlefkrfstsiasedmvtsaidanldgrngeyfnvslkdeygnplinkdikigf ngriynrttdsngqaslqinlkysmvytfaicflgnddfygsftvskitvktqkpnlevnnfkyksstkskvikatlkssrnnpiggkt isftvnnkvytaktdskgiasvnvslsskktyaftvkyagddtyssvsksanilvy |
| Contig40_gene_411 | 94 | mkkniflaiiliavvavsgcinspmdninnnmkelntditegdtdynsainyinnkdfisgtdniqiakdkfndadeklsnieqykss lnesiyldylylikeevsikrqasdelylalqyytnndfssgnsyaqsanslmnqakvlqderngivennpdlfkkagii |
| Contig40_gene_431 | 95 | mliallglsavaavdadpltdnqlnptifyldfrnhgalndgfkkefdlfeyvptfdsvdlyndgenvsvfsylnptidvdnlndeiid ytfevmedpkanittlkdgirnicseygaddvkinvdsvigedeipvifttegdsmlptiksgdkvlvnkshnihvgnlvsansseygp ickrvadidgdsvylvsdnkkvtreyyddyvveykgittwvniddidgviididmn |
| Contig40_gene_448 | 96 | msennrtlitigigafiiiaillliaivlpfsnlavdndeiavitisdtitygdnstsahtskkeieselndaysnpkikgivldidsg ggslvasdeisdllikkspkpivsyigdkgfdeayqiasatdyifassssslggiglsyintdrysdekvtgvfnekylknnktksnskv ksandlanaqkmvdqdytlfikkiaenrnltadyvaelahgkkyngneakklglideigsksqsiekaaklsnatnytvltypepqkkl teilgendifnlkeliki |
| Contig40_gene_466 | 97 | mgkifkivtliliviaIailgvfiysdghsekigennlgvvykvtyghsndpnvtigivsgmhsreklhqyvlpyvskafaflhpdvki vnyivnvtkdpedftkgrangeslvhdyvvkdvkkedfdvviighdhepgygeayyiatpvmdnasvklakkvtkdigfnhytrnksqp ttstsilkvdkpivdagtrvfvyeipevdgkvnafyksyqlvnatynrlkk |

FIG. 7C-93

| | | |
|---|---|---|
| Contig40_gene_483 | 98 | mdkktiiiaavailviagiavfafggggssdsdpthltvathsnmaepeagfnpltgwgcghmnynplvqsclfktdkngdivpdlatn ysisadglkwtvkvrddvkfsdnstfdakdvaftfntakdtetdldltnikkvtakddktvvfeleeprstfiydlryvgivpeeydna tygehpigtgpyvldhwdkgqqaifkandnwygdkpyftqitmlfpeeatwlelaksgqvdiapvatsalnesvdgynfveksagragg islpyledtgktspagakignnvtadksirealnigvnrdkiceevfsghaspeytsvdtrsfanpnakvdgdvakakqilkegwed tdgdgivekdgvkasfdlyyppdyldrqslatvfaeqakdlgiqvnlgadwdtiyanmyssasvmqqtspdpyksiyqqyhskeaddf ymnpnlynntasdmlmeqamhsndfkladslwaqsalvnggwgpagdapwvwlanynynyfvkedidmgdqpdglgndflinvvdwtr tnsta |
| Contig40_gene_501 | 99 | meinldhkdhdgslsiigdsnggtvfdgenlnpiiisisedsivtlinitfthgknnmgsairssgnltidncifteyatnlaalyvd khspltvmnskflenrakqcadiyfsqnseiillnnlfegstaeysyayspsvslqtgkslvkgntfknltgayykgalyiayngini anitdntfincnytgtdgailffqnaylknnkfidchsstaflysntefnaylsfedaeidgttfflkanvtddmgnkvknakvifyln genvgsassdnngvamisikkllengeyvisgtqsyseinpfgvnvknatarvnydhsslevwstdgddgsngsednpfktlrkald ygtasavnltvhvkngiyngddnrdlsystlgkitivgesysnvvidgenitksifafsstldvtlinltlincpstlinaytlsmmdn ivinsgtiraqtgnngvtidnlrvingtdqaitgynlrltnsrfencdglthtgliwlstnnnkvtylenntffnntiagsaggaayy iqsdlisinntfdsnwitesrgenvayaggrhiisindkfinnevpkyvaqyrsigneeceiivenitfinnkasgnaglattgaivk ggkfinnsasgnggailylnhdntssycqmsledvifennsatcgkdifiegssgnniftylnnltivandinvtslsdnltvsvfhps gaiiggeisfyldgeyigkstlvnqnasleyvgfknntiyeftsiyeyaslndtyidgivstkipyalenielyvsdgsgddengngs isnpfksiskalsegyqkstnitvhilegtytgslnsnlriptvnilligegaaktiisdsssdyfitalkgkcelrisqmtlnraar dtqsalyieeesnvaidnvtfiggqgnyggaintagnlsirnsyfhdngyadrtlranayyggaicndgtliidntifesdhagrlsei angqtlymnskvidsinayisinmdlvaigayggqkgeitiensq |
| Contig40_gene_553 | 100 | mkkkiaiilgiallaflvigassagfldflggdgtatnddntfivgfdaefppyygykddngeyvgfdldlagevcdrnnwtlvkqpidw dakdseldsgsidciwngftingreddytwsepyidnkqvvvvktdsginsladldgkivetqkdssalaalegdnktladtfkdltqv adyntafmdletgacdavaidigvaqyqisqkgsdqykmldeeisseqygigfkkgndqlkdqvqktldemfedgtveklaqkydtygv pgaliqk |
| Contig40_gene_636 | 101 | mnfnkkilliialvfiasvglvaaedatvdpytftipddytiatsddttcamqkdathaisfatgvsddieaakqnfisggktllkees mnyndmditlqafsadvdgttiicl |
| Contig40_gene_721 | 102 | mkrsiifltiilslflvigyasaglfdfssddagsgentddvfvvgfnsqfppfgykengeytgfdielakevarrnnwtfkpvpiidw ntkrfeldsnevdciwseftidgreddytwsqpyfnntklvivrgdsdindlddlkgktlevqgssilntieknetlkrkfakieqvd gydtafmdlesgvcdviiidsglgrylvseknhdtkilnqtisnekygvafekgntelrdkvqktldemyadgtvekiaqkyskygipd gviype |
| Contig40_gene_730 | 103 | mgitftaiitgalggttfseplgnylsqfipysyqisfliivililtsyftilvgeivpkrmalndpegyalstakfmqissiickpivkl ldsstnlalrivgpspkedvvteeevklieegiedgtiaeeediikrvfriddqkvdmimtprneiiwldledeieinkakiiaskr sifpvadaelddfigvvqakdllskifegedvdiranvksplvvpenmlsmdllkefkenreyvhmvlvvdefgsvvglitlndllegi vgdipgideeddpkaverkdhtwlidgrfsiedfkdlfeiekempnevedgyttiagfilshagkipetgeifhedkftfeivdmdgnh idkilvtineedsdkldlesked |
| Contig40_gene_732 | 104 | mdskkllivtalaflaivsiasvsawdlfgtadetsstakttiaghdfnipdgyqknesyvldnettnsngaifystaesyykgaddii yiqvadyspgyeanlttaqllksglgdketinghegliaenefdglkvhaffyaedgdcitvitsddnlfeqiipea |

FIG. 7C-94

| | | |
|---|---|---|
| Contig40_gene_733 | 105 | mnvnkkifllvifiisisiagvycadihqdsdltailsnetdsgltaimsnetdsfgccsivlqldgnesimcyrrdsnytadvfiekv nwhgkpaikqyktdnkyfnhviitndgwiiglggiddgidseicenitakmitkdysisedyltqigeikkkygrghvvikapngnygf atptklktgtlnvgeyisipnnyelsrrgyvsldepdkieaminlsrtdlygddrreiitydvhlngnnttdiyisnedgsligkdyt gcvdnvifnnvtiegkdipiapnykslgsmsfevdkvnlsltdlafivvgvvliviallfvlllrlirfiktrrsrsaprrtretprs srgsapsrtrrespsrtrretprpnlrnarrdteedrrrndlrrnvlqnivedkrrseprrnvrrntrnnrgrrgqnrgrgqtkrpp tlyrke |
| Contig40_gene_749 | 106 | milalfcfivigsasaadfkindgfnsslsdysfynedqnmyiniwdyddeilseaylenssyrivsgenntynfvfdsyndmdhvis yitkgyvaldcgvleiaevdgkkqiilvskegtnvdslktcydelmkfnqnnniepiadai |
| Contig40_gene_750 | 107 | misllisilaisaasaaddmvdadidlasseisevsvddvqatdknvlsdadevsvtqntpynenatidisvngtladdstiklfid gedkgdlnlsaegkasyvipastldvgkyfieavvhngtssfggrstlnitkvtpivssdvtvksgdyitipfnvtddkgkaipgdvi vtlwendviskhiklndnssagfniadligifggnstgngtgtgidlfnrngtngtgngtgigdlfnrngtngtgngtgigdlfnrn gtngtgngtgipgignstgngtgngtgdfdiasilamlmggnntgakfayvfekgvynvsveylsnrnyngaindtakltitpledv linatietaknmsdnttvsilltdgyekpiaggeinvflngedkgkvtaneegkasiafsnllkgdyellnyketnktfdffvnverm gtvleyedmnttsvnekvdgrigeyfqvtlkdnegkalanrfvqigfngkiynrttddkgqtklqinlfytgdytfavcylgddaynas fivakikvskqtpkittkdatykadatkniktvtlksakdnaikdkkisvtvngktytaktdekgvatvnvslskkgtysftakyagds gyaqvstkgiltlk |
| Contig40_gene_762 | 108 | meekialaacsgmspnglvarvavhdlaiddheilsicmgstsanvegftrvldkypilaingcegncvgkilkekgvdivgelnvgdi laeteykandaarlddegeicvkivkdiiedkinelse |
| Contig40_gene_766 | 109 | mlktkicgislknplmlaagvlgshasslnwilnsgagavvsksfskepnegyknpttvaveggiinaiglsspgvdafieelesvnri kgrsiasiygatpdefsyvagkieslvdmiemniscphamegygasigqnpdltrefvsavkdtvspvlakltpnvtniseiaiaaee ggadgltlinslgpgmkidiitgnpilankfggmsgpaikpiavrcvydayeatdipivggirnytdvveflyagasavqigtsimy egpeifgrirk |
| Contig40_gene_769 | 110 | meivlcvtgsvaavetvklarefkrqghsvkafmtqeatkiihpnalefatgqevvleltgkiehvkysqadlilvapatantiskfay risdnpvntllitayghdtplvfvpsmhdsmydavsenvaklkeegivflnprldegkakfpaigdivlesirtvnldrvkknltdds1 deseiedlnmemlskiaglnvlislggtfeeidpirgisnrssgkmglelakeayrlganlkilaahheveipkvfdvidakssvmse ktielvpdfdvfiataavsdfapivkedykisssinlslefepvakiihqikkinpdiflvgfkaeynipeermiqcaktqmqdagtdl vvandvykkgcefgsdsnevilvsdeikvglnskseiaksifkeianki |
| Contig40_gene_776 | 111 | mlsmasvcasdvndtyinqndlkidnqdncinyekvvyteenlennlistedsledsniepsdsfkqknslnegnsderlnpeidval nsihvnetaevnvtvrnasgyvlsvddqsfnkdltdyqarfnitglfgnhniavyygddnylpgfkletisvekyqtqiseieige vyygedaiievsvpngvegditikindtlqtviteaihdgmalfsvsglavgsysldatyngndyyendtasaefevkkadpnlsvvsf ectvydnatilasineeihdefvnitvgdekyedcpiedygmiaftggvlsnfssyrilieyggnenfesamieafvtpkkittygldi iaqnisinddeiisvvpdhvddvvvwdqgsyrncsfennvavfnvtglgegvtvtatvndtefdhknftsiftvskvlpsigisin eteiyvgdnvkiivslpidvsenvsivfddrelsgkpvdgnatfyidclsygnksvpaiyygdekyrtavesinftvnkvpsflnvave nisisdneviinfslandasgnitvivndetyivavsggkgtltvpklnggvysvnasyngdgkylpslnnsesfkvlvnsgmelider nntvsvylwdgatgnlsvkidgkvynatvvdgfaqvisnasygahayvlyednesdlklesvvdvfvpkylspiginssilkvgdig yinvtvpmgasgnislleidgksyliaidngiaefevenltagdktifvkysgdkvysqnstseesltvfkqessthcsiediisvdvaqi kitgpsdvlgtviviingseytasisngegilnvynlqngdyielsylenskylsseyrdnlsvskiqtaisssnivcqynyegylnv slkdikgnpiscaelsididgvknlvsdvnggvkiptkldandysvlisfagdekylpsnatvnvtvnkdippqiiasnliadyksddy |

FIG. 7C-95

| | | |
|---|---|---|
| | | liiglcdsqsnplagfdlsialngidgdydvystdsngivkvpik |
| Contig40_gene_787 | 112 | mvvatiifassIfdalygfknliqpgislvytaigtqlapnmvtlvvfdwrgfdtlgeslilvtavlvvllifgkgkildknvnadngt adsnItheadleigdsdleIdgadlnegdde |
| Contig40_gene_815 | 113 | milaillavgmtltavsaedswsfnfsseensdggsinfengkltiggieftipdgyemdesskkvaedaedfdakysackftkgddei vvnvfftdgdfenlsannadqvektlndikglyeenkygdntptftyiedgkvvkinapndeiiesvmgk |
| Contig40_gene_824 | 114 | mnkriflyialifiislIsfsavsanedissdnlildenvydekiilddvqdkniisdndyddvipvenandnailagndeelildenn seisednknaktklsdpntysftrIngainsgasvinlitdnyqytegdesfihgimisrsitingngntisgsgvarifevftsnviin nitfrdayaegdsnrqnyggaifmygsdsivqhckfinnnannaggaiv1vgsnsrveysdftgnngqnggavylygnntkaiycnft snnasekggavytygsditvefcnftnnsayleggaidwegergtvkhssfanntanngaiswytangtvehsnfinnrmatfggai wwygekgtvkhsnftnnsgrnggaiqwskndgtvensnftnntailagavrwvadngtikysrfinnhgysagaidyhltyanisgclf inntsdyranvyedlfesksysnfnnillnggneinfntsegfnadynwfgdnslnyldkpniysntwlflqpivnhdsvflgesce itfrlysydgtevheydnalvypikltinsnygnvndtvgleekaiftpqtlgytsvdvyaegsyigsvpinvyypsfsdlnrtingne dsiitlnkhyifdpetdaafingviinrtvtingngftingnsnnarifqvtasnvainnvtfangyangstdedkdggaihwsgangni enstfynnhatgaggaiiwqaqygnvstclfinntaddganvyhnnypsdshsnfnnnimlyngnnevhftvyngsnadynwfghnssn yndattgligdiwlflnatanpdtlilsnsseisykIyayngrelgeydnhliypitItlsstnqivndnvaleekviftpqnigtatv takaagtdigtisikvfeasfsdlnrtingnegfeiiIdknyayipeidaafinginithtvtingngntinglidkarifqvtapnvti dnitfingyanddgainwggpngiiinsefinnhatsaggairw |
| Contig40_gene_828 | 115 | mkynkkifflflliclIiipqaiyagdvddisdagnytrdnspltisstygsstygsdggyddkneniyildkvsdgdksktccskdlsl dnacsmdksscsksnsacskgissdkdssnlsntylvsennyndfnvdidlndklsdldlnndisInkdltlnlnsnndmylnleevi qtdgtltyegdldqtylndesIngdvqnddsInkndiksplsdentfniflisdntgnnlfdavaceildrsnfsnvkfnirsgnqina msedeiyelmapcdafigqwvssnvdavltslinnhpelsnkklflilepptgninsssslnivrnstidykkifngisnddlinyfk atkrgnnfesigeyidnegssfnsifnnlvlykdindkanlknellylilylighcsyesanftgvqasgifrdrwysfdeyvltffne srnrtigilestmyigsqidlvneiterleskgynvipiycpagnaeqlnimvkywtsacsnisgflenpqdfdiyvdgiismvaygv ggenftnatkffedanvpifravhseyitneqwelspvglsttksdkwwhvtiaesqgifdatyvggvdsyisnrtgaililtfvphen ielItdrvdawvdlkytpnedknisivynyppgkniqasyldaitsvynmlytIkdegyyltdlpnnvseledmmiacginvanwap geveklanrsgvallpvdeylewfdsiddivkvqitegpvayigqmvrravlinytdevetmvndwyngikallpengtvaatnildkl vnsiklyanassdgdenaslyydeflryydefksInvsglngwgeapgnimIvnrngtdyfvipgltfgnvfigpepqrgweadienly hctavapthqylaayymgtrgsnamvfvgrhathewlpgkevllsyndygsivvgkvpqvfyitdglaeaigakrrgfavlishlds pksythlygnitvlatlIeeydnnhiiiesdsdkdnqaityqvik |

FIG. 7C-96

| | | |
|---|---|---|
| Contig40_gene_829 | 116 | msfgavsaadlntvqsgevsgqvdiassnpgvengeltyeipdsveniqyaglfvdsytagssnlvygseanitltkngeseqiaserl vasvgsadgevyvindhttkcfadymmtynltdrlqdakgnititvnatpiegytfynkikliglvftyddgdgqfhywvnagsswvk tdsgetskatfklgnvnydptvatldnfalssqdgvytfngkemdesivtetgvyyyihhkfdildkiknmtntlvytpgegsysfrnv lsvvklvktvpvyakvnisseyddivfsgtenllkvgitnngtgsasylldlyadgkkvnssqislaagreavislidntirpsaadtv sgadnkkinytvvvsdkntgevldessifpnllyngylgkglaypaekissfknitvnggmiieslgdstyldasmtgktdswtidlpd gafftdafvypynldngnvpmftstfngaavnpiasyrdqpnigenakngygllvydvgelikagvnsfalskeagiagvypstliaf ynltdsdlltsafifngadllsneynslgrdvssdnilsigafdglvsaklhvfaadcqagegdtvngksyknvwagtnrsvgdyvd lgkstnasnevsfistasnilalqglavvqynvpsvkaslvseysnavfagtnnvlslnitnngkfdsiytvdfyvdgkkqnsteislk sgangkylyliddtirpidastvngadnpkvnytvviidkeksmvldeititpsllyngnlgkdlaypaenitsfrnitvsggvivdtld dstyinsqatnrtdiwnvnvadgdvftdafvyvpynwdktngympvwnarfngvavsplvsyrdqsnigffgkngyglvyydvsklliks gentftlekeagitavypstlmafynatssnslktiyiyngadllanennflnrtvasdshldissfkevisaklyvfsagaqkgegni ifnnktykdvwngtvnsvdsfiidlgkspsvsndvsfvstgstim |
| Contig40_gene_830 | 117 | mpvwnttfngvtvtpvahyrdqsnmgtygkygyygliivdvsdliivagentftlekengttavypstlvafynmpesstyvttylyngad llsnannflgrlvasnstldidsfdnivgadllvfaasaqagegslvingdlvadiwngssnsvdayaidlgknpkasnevsfvatgst ilalqqfivveynvpsaeaslvseysnvafagtnnvlqfnltnngalntsyivdfyidgkkvnstgialnsgesfgqyfiddtirpvda stvngaanakvnytvlvsdkdtgiildevtltpsvlyngnlgkdlahppeeivlfdtitvngdviidtlddstylgakttgrtdewnlt vpsdadfevaylyvaynwdktasgmpewnttfngvnvtpvahyrdqsnmgtygkygyglyiydvsdlikaglntftlgkengttavyps tlvalynvesnvlttvslfngadllsnannflnrtvasnnvleldftvfdeilssqlyvfaasagaegnlivnnetftnvwngtsns vdayivdlgndpslsndvsfvatgstilaleqfvvvkskyqtssdlqklidaaepgstldlgdnvfqdvanvvidknltikggsimgka getifvipaksangpdevnitgvdfivedanvivgatadngsspstsidtpnirisdnfidmidgsvvpesvtvlkldsergvlaptgel kvtdnaiaagikpfefdvtgvsngsdtnipegqnipakqasvihyqdmettavnskiegrvgkyfevnltdtngnplankfvqigfngv vynrttnetggvklqinlgykgtytfaisylgddyvngsfvvskikvstqntklttaaktykasaktktltatlkssvnkpingkkvt ftvngksysattnakgvatvkvslstkktysftakfagddmytkssvtgkvtik |
| Contig40_gene_834 | 118 | mnsnktyavlgllllllsigaisaedsiddmsltdinsadnsninqinalndnsidtstdssidtdnsietnldssiedknstdakntl ssnslastykitekdyltyfdkdgnilsgdtidlsgtfskkafviniplttissdgtakllnsninlvsgagsmvsnlnmnts vektpalsavnvtkvsfvnntvlstatgsyallntvnnsdvlfntfqttcfvegwghpsalvlsgsnynnissnnvivndsngiyltg ylgggsmgdstqgsntynyiynntvhsvrgvewakdkdgnkplpssfcygiqvmgayneiientvynmyrgisatqtgnkvvnnlsni hgtwysgtnddgadytiyvttnsivkdnsisdskigdstaaihaaantnvtnnvlsniegtvliegnvvcnknsllgltndgiiak gnvsnidisgniinasetavslvktsrslaphditvsentifttkenpisyeeaystnitvennriikeasngtdpstegngtyyiids nfynyfdntgylkstikendilifvgpieskdkiyinnkvnitgidavfkdttiivlddgvvidgitinnpneakndrewgiqvngakd vtikncnitiydafsayavylidssdcklinnnleakgdyltsavllyntnntvlsgnslktigtgqnytflnescldgcldgcl dgcldgcldgcldgcldgcadgcadgcldgagvnhiisgifrtyglfmvyssnnnvtdnkvdvssalekgyatyiestnaiggifihh nsnniiksnnitlngndpfmygagvvggnsnhtdyvssnngfesnainvkspyyaigillgynsskstlksnkislsannysniasy kssentvdgtvtvlkdtivtstnitagsnspivlnltvldednktvtvgsllayvnntlvnststikgqstslgigaypkgtydlvvlyv ngglyrvgagacqfnvsdvintgngtkdlgnaldnakdgatvdlg |

FIG. 7C-97

| | | |
|---|---|---|
| Contig40_gene_835 | 119 | minkriislililvflliglsavsaedsskaadldlnssvsnidlssnsvaiesnsniasesssnivldnkssdttdiqtdsdss<br>sddnlnhdsnskiksdnskkvhtitesnyslyfdsngylnnslvssndtinlsgnfsskyfrfsipltitslendaflrnspiiitgvs<br>nenyvydaivsnitiesdlanisavwwigssnikvlnnniffttghngypialdsfvyncilanntiktivpvseamsskdidednqtnn<br>sdnsswqhsgislrdahyntvvdnditvensygvylcygasisnynvianntiratsetpsfwcygvyitgnynliygndfyhlyqgvh<br>ssypynsivssnnfydidgldddnygaggdfgiyggnntlianslynaklynagilvgtnsevygnyiqinssgegirigdkeggsyskv<br>ynntvdfldgkgiclygepnstlvydnilnsissidsldlsaeskgsglgigiyshyqsrakrpynistcnntiytsndyaidisqsst<br>kaytcygnlvfgkgiilypmevvypdygegnvyevsednfytyfdssnklsdkvkdgdslifvgefspkgkitlnkevnlfgygallkn<br>ttvfinapncrvhnftivnngideynlwgvyvfeadnasivgnnisildkntsgiylcdsydnnvsdntiscggdnlvfslltyeayd<br>tlfennkilaigtdelypyyeticidgvhsiselsktygvildsssrnqfihndievtstlegfhvpynpsvnilighyiyyasnynni<br>sennyvhghdpflygvgssgddtsksvtyacenifshnnitvegdyfvmgmilrhnskdtivdsnhfrlnsnnytygitleisegakv<br>tnnvlnstgnagiyamelyasnnndiksneiyasasyssvalyassnnnvthnviktygnkvqepaqgpehpdsvdlfntgislqkfss<br>gnnisdnlietdgdaavdfdetstgntvgnnelsstkgggnaavn |
| Contig40_gene_836 | 120 | mdfkkaiplfallllifiigsssaassdlssspadnenleidsfdsnedltvntntnyiesgnnleidyksnskesvnatndikeetv<br>dynedisveknnlksskissvykitesnysnyfnksgnilsnvnpgdtldfsgsfnnkdfkidipltvtssdgaqfidcsfkfnkgsdg<br>snisnlninssrlqsplliyldsvsnmnvfnnnlfscasksyalcfsnvsyssayhntlqttafvvgwghpsafvlagannlnissnnvi<br>vndsngiyftytvgdtisanlinennyifnntvhsvrgvewavdengttplpssfcyaiqvmgsgnkllnntvynayrgisasgsnsvv<br>agnvvydikgnyysgntkddggdygingvpnsiventtiynshfnknsgvaisvgsnttvrynnitningtgadisknfiefshnridn<br>vsdngirvkgqygntnisdnfinstdssitllrsskdkypsrinienndfytdvspiyylegyigkltakdntlngssisdisidvpss<br>setkvsinstkidfnesvlimptvsayglsleglvdliivnsqkiatvpigsnytftpteagsfsinanftgneeykpsesavliltvtp<br>kettsiilispstvelndtvvispfvryngtllegfvdilldgekldtveigsdysyvpnssgsfyisasfsggngyasvsdmlltv<br>nesssiedpddptnltvssilispntvevndtvlispfvrcngtlleglvdliliidgevdkisnltfnnynkdaivinelayditvennk<br>yepsvsdivvltvnekqiidngtdnngtdnngtdtngtgtngtdtngtdtntgttdngtdtngtdtngtenngtdtdqikiiinddnysdyfdng<br>ypidldvdgnytliidslnnkdiilipsgfniniigkegsgtinngtiqlgdgtdevgdvkisnltfnnynkdaivinelayditvennk<br>iiinteaspgnlyfsvyginakgyvdslavrdndiflngsapyly |
| Contig40_gene_837 | 121 | mklkkfsvilavllvailaigavsaesvsdtdvaavaavddtagtvsvddsidddvsvdtttdndvknslsavaledgesvseindtsys<br>tyfkddgtatdelsemggytlnigtlnkdiqiisgsdinitakdgegfinngtiilggdefpgsiivsgltftntnkdaiqvldyttd<br>vsiydnnmnigisslssdpnfsvygvsangflisglyienntmsvegdalsygievgaysdgayalsnpqdilisgntidvstsgamae<br>pmylsdvwdtvvnnfvtaesvnapaygiqvadsamwasymdpnydgdlsspnnvlidgntfilnsdfmiygittinygwdgiemesya<br>lplnitvsnnnvyanskkgvmgiaggiynltvidntviaiggsaeglytgdllgngtyalyidydgnyaedtyvvvkdndvftnvtke<br>yafnndyervifennedlktfviddetysiffnddgtsdvledmedytlmigplnnkdivldsgseivilgldegyinngtivldgvsd<br>vyvsdlvfvnvnkdafyigdesneivivdnaivlvgkaaestnpyfslyaisangyvtglnitdnsiyitgdapysygislsayaaefn<br>peditiynntiemslsegssmaeaiyldcpsdatieennitietvgntfaygiqvadtlpaayeyasyrgeltspelvtikgntlniss<br>eymiygitvlsegalvngsgdlalcqfelflnvsentiyadstkgviglagkvynitmnnndlyvtggdasdvfsyddlgvgtyavgik<br>yngdsedgnyyadvfennifnvsaeyindetvldeyvffnnfipldlgivleadkdaleigdlinytitvvnngpnaasdvvvsfels<br>dilllvtapeeydaefellnvsdlavgqekvynivaqvidggyllstayvdcyeddtymdnntasldmiavpividdsnyanyfnengy<br>lkddviatgtvvifgnltnkdlfinaplllisdckdtklvnttial |

FIG. 7C-98

| | | |
|---|---|---|
| Contig40_gene_841 | 122 | milislilvilsiscvsanditndaiggdlsdidysftidddlsnsdnsldvssdlkenscldeidldkesnqttkilssnqldsnll dsnqlesdqlssnqldssllnsnqlnlsntytvsqstyskyfdkngyvktsvvapydtidlsgniisknfiftipchitsnnakltnc mikfenmtadgrssvsnlyirnsvewcpgvflegstnvdvygndiyctgangnpvrviysnysnifgnkletyftgymnlswkragill gdshynnifsndvtikdsnpiylttygfeksnhntiynntvrssaisedsglsnpsawaygihlmgdynialnntihnvyrgidsegsf nilagniifnltggyfegndgteggdygihasydnivanntifnskltgsaiylmpnntaygnivynisghnglefnyyadnckvynni idvpvespiyvfgrmnlliennlitsvdssilvkkqsnskyptdvtirnnlimgysktfngspidysqiksdaniisfnnsiavynd tyfnyfaeignvrdysdwidlnntinysdsynynalvfvgnfssitdnitktdyiiplkdivnsrisdvyrnvpyneyksmmetlneiy tdivfngpspvdlrgvdsggnssdsnqtpmdgngsmnessdngsdnstnssldnlddevkdsyenlidninstenasdvyvindanyal yfnedgsfrddfpiefgntlrfanltnkmfkidiplkiisdsedssllncfislegessntiisnlkfeldnlssnidfisikdgvsnv liynntfkldidssdslidsplsddaslsairlygsdyisrnifienniidfksnfgqlygiylsnkmdylnsktnpsgfiirnnvfsi dsnglinaiysdsvknlllennifnlssnqnledssliygldlvkvdnltminngfsinstylacginssdssgfnlsnnqfsvdsayl ayglnlkntnfnlhnndfyidsgsfahaldlddcnnfnianli |
| Contig40_gene_847 | 123 | mdnsniiisviivlciaagvtaygisegdnavfsdltgfspsstdsgdtgignttgnnsqggitagqtnvatngsssggssgssgss gsgsgsgssgsgssgsgssgnggnntnpspspskisaaqakniaagaiaeegayissvsdtgsayvcyisnaegtnvgyitvsyggaiie gaggap |
| Contig40_gene_848 | 124 | mdnssilisviivlciaagvtayglntdsntvfndlsgftpdesgdtgignttggngnsgsgitagttdsgsgtgssgtgtgssssss ssssssssssssntqqkawkpkvspekakalatsaarnsgwpgaycysatynsggyyvclikdagntgyahigsgtgrflegswskq vtkepneveddykenetsnite |
| Contig40_gene_867 | 125 | mrkeiliaaialilicggvfaasnmqiadiatfslnaidledrgslivdseditaskgyynssasdenvlvknysIrlsnsivnktg dtgssgddadfyginsavlvnsngsvelsdveietnskgsngvfvtnavsdsnsnsnsssspivdsterhdgksdaeepggvppekpv edgpsvyggssgkgalsdgnqsmpapgasssdvegssadisnvritthgdksrgldatfggkiiasdveintdgscaalatdrgeg evhvkncilntgvdeksgrgspiiystgnitadnsegcahvsqiaciegknsialsncefsagagnredngeyvdlggvfiyqsmsgd advgtslfdanccvlsieedseyyktapmfhvtntkaivklastelnfgsgvllnvsgsqwgtvgsnggelefdasdeilogdvfvds isslnmslastsfigavnpdddfgetnlvidssdwtldggdshlssslenngdidynghtlyvdgkaytesnpfk |
| Contig40_gene_872 | 126 | mlisivlislialgavsaaddvaddavapatvdevqtidntitnddisyestdiivndtgdsadskakttslsanavnegetlsftql aadvsssspsmlsgayykydpstdtafengitltngltiiggatidgdnqarifnipegvsvtimgvtlingaadegaaiynsgkltlm nakvndntavksggiynngevlvtssefdgndltdrtvngygaaiysnggsvtitdtnvtnnlknivhrggtgtytgdlssaavts nnaditvtnsrfiansgsyggaiysgestsanlivsgstfednfafngaidivgtsytisdstfknnnvkgtsnsnyasggaicvq dannpglisgcdfeansgvvggavncentmvldctftdntansansetfngktnnrggfagaiynegtitisdcefddnagregirvk naeisdssftntridtcqnsnvlltnntynnpdrdvqaasgtqvtvdvacgdipnantapyivgdltftdlqalidsgssgirltgnvi ktaeeettfadglnvdktvtiiygaegkviqansgkifnvaegktltlrnatlqgsgetaitnygtvtylyladnnqftdcgdvlidnhgr ttetgltftqlnnliglvnggtvyiqeskitkaedekeayknqividkdlsilgsyntyykyvktsinanndgriftvaegkslsIky invtngaadegagvyvsedatliadtanfikntavtkggaiysegtvdltnvniknntisktdgvmaddnggaalynngtatldkvnv tdnqktyvigdimdgvvvskgattitnsyfannsgrwggaitqtgdqtltvedtifeentaifgaaifdnsplvvkdckfynnsaigp gspgtsnsqgaailvmddtasadisgsefinntadcggavslagvgsdssiddctfidntayadgavyfwtesasvtvtdsefisnta pyggaieneglgdlivdgceftentaslrggaiissgdtsvsnsk |
| Contig40_gene_900 | 127 | mkeialyliliivliaaghlnvvsgsmepvmyrgdivvlqkanlfgihefdphdvqgdivvynaawydspvihrvintaeingttc feikgdnnnksdpywtpeqitdrvitingqplvipkigyitlwvkgl |

FIG. 7C-99

| | | |
|---|---|---|
| Contig40_gene_906 | 128 | mfeagmialptglpglalliglgtvltaygsgmfddlgtdhpgyakpenqlnfglsmqlnfiglgaseglargvlykevqeklvtgfvps<br>ikaygktimdeslgkgnakistviwayvensvilaiensingg |
| Contig40_gene_909 | 129 | mknwkiiglililavvsvsgcigddssdttsisadalnitedgtydskeevaayideyhklpsnyitkseakalgwhggsvekyap<br>gkciggdifsnrqsilpigheykecdidtlgadsrgpkrivfstddyevytgdhyasfehlt |
| Contig40_gene_917 | 130 | mvqntnlsnntavfnesrnetsgiggaldvvgnncqiinvtsdnnnayrggstfirgndtvirnstfdnnnatlrgglniagegctif<br>nvdvsnnaagenggiyviadgtefrnitadmtaerggafvegndiiidngtfngnkaifneskpdesgiggaldikghgcnvtnvd<br>sfnntayrggstfirgdntylenctldgnnatlrgglniagenctihnvdisnntaglmgggiyviadgtvfrnitadnnsaerggav<br>fvegndiiidnatfndnkaifnesrpddsglggaldikgdgcnvtnvnsfnntayrggstfirgdnthvenctlegnnatlrgglnia<br>genctvynvdvsnntaglmggaiyvvangtefrnitannnsaerggafiegnnvtidnatfnnnraifnetrpdesglggaldikgdg<br>cnvtnvnstnntayrggstfirgddtyvanctldgnnatlrgglniagdrciiddvdvsnnaglmgggiyvvsngtefrnitadnnt<br>aerggsafingtgitirdgelnnnraiynesrpdesglggfdivgdnilvdsvhsnnnsayrggstfirgsnvtvqncnldnntatvr<br>gglniggqdqckvinvsvsnndagedgavyvigdfslfdnvnstnntaqrggssfiagnnvtvincnldnntasnrggldvngsgc<br>vfenvtlsnchadkeggavyvrgdnvfnvtsenntaergggssfvagdnckvincdlnnnatwrggldvtgtnclfenvtlsnchs<br>dedgavyisgddnrfvnvtsvnntavnyggstyiggtsnsvenctisnniaynggifiegedskftnnitfnkaiatedhdfnim<br>gggvfilgnnsnftnnissnhakdnggvqiffgpdtfmdkiyafnntaenggfanllycdninvtnstfysnhatgdisldrgegga<br>fhmsyatnidvqgnfsyntatngsaiysdgsdirvhdssffdnqa |
| Contig40_gene_930 | 131 | mrnkkififtlmivmllslaavsandldnlevddgnvvstdtvindvpmestssdkialnvdstgsntteilneneiitnnstlsidln<br>esitneissdhedsyqadsnqedsyftsdgniyvkvktsmlkadgdqiyyihpagsptatgtrddpldsmnsalnlftsdgthtlvvmd<br>giykdtyydynntavdtnlsnliiksdegasphfnlstsdyrrslywaftgenitidglkftdsqygsfnedgvkyhtvlrfinstnv<br>lvencvfdndgylinatdssdvviknccnvsnsnrsnvfnvlnssfvqdsnlskirdsyitnssfklinnticnnvnsnlftvknssld<br>iinntfkdsnyssyyvfriynnnetyanftgnnfnltgtdyllqvnyvyndnttvsfvnnsldkvslglniryslnltmdgnsfdnlsl<br>ssrpsysgistsysnvsftnnnftnsdsyiylygvnatiennftdnipsyygllraegnshdikennftnnkgncsiighysgnati<br>hgnhfynnslngcghvinvtstsgseiykndfvnnsadngtvylygssnvhdnnftnnsvtglggaiysysfyninttikenvfdgnna<br>sfggaiyyenypsynnkreivnntfinnsadfggaiysnksinniiddndfinnsaqigaifvdylyindfrynntnntisnnlfaen<br>naqsgavvlysqpstvegnrfisnnasryggalitsgnnsiivnntfannntaqlyggaigtndskiidnkfennsayqagailtins<br>tihnndfvgneatrgpaivyiddfnytaltyytyncscencsncsgcsdceccvttivdpetgdeikiincsncdgcnctcenstvteh<br>nitllynntgididedvyayhenqllrvakenngmyylydnvnvtsaenytywayciequnsypwlgngtlgvhvddlyfvrnslddsy<br>vgdylkilisyfyhnldedkinvkeyiyiftdtdyrsnndriiqk |
| Contig40_gene_964 | 132 | msikrilltslmlfiiifsisfvsanenvtndvstnelstqtvsndittsesisdtsldsgenrgldeiksnteesssnldledgtl<br>ndeiesddcltkngkeatlqanklsldinmsrgtaqdvldaivrissqgggtlyingtytegharvynndtdsfrnivrndgivdi<br>snvrvggsvdnpnqyatfqpntrdstslafsgyvwdgngtryypdsgfnltnvtfenlnctgrffsfnsgyltdcvfnnlesyqhlif<br>fvtgayndgkpivltncnfntnskqtyrgdngdtgtgfgfvfgaemycnfintstathggafclsdewisaacvpsklvdcnfi<br>nitsrwfavyihgnysnttrfitepqvvencsfinctategfggalgishnnviinntefihnvggkgsaimvgginnthdgflgvntq<br>gnnitlynctfedniakiegqssahstdppfttyptyggavyvygnhtkiidstfnnntaddscgaaiyirgdnttvvnsefynhtse<br>ngtiylvgndckikdslfhdndadstgacifvegnraeigntfvnntapngcvfiigdhtlvdndtkfitnatngagiyvngsntm<br>ilntsfinntavngsafiyghdtdvngsyfegndatnggavfiegnindisnntflrnnatnggavyidgnhtkvnynfteneaip<br>isedqetglggaifirgndtnttantflhnkarngsaiytdgtnfylhndhflenqawsyllittadpaeslykeqdieinvlyragdn<br>iinaihnrnkpnethfmnvtyshsefgnittspadqyvepvdqvensregellyqddrenyqqielrvehengdlalprtpfrtniygn |

FIG. 7C-100

| | | |
|---|---|---|
| | | vnttlnksslrkglyvvgaehiedwnykfimnstsfrildtmdimvnktsdkeeyfqdeiaeweliftntdngtdaenvtmtdhlpnvf elmnlsymfytpteaitnatlylnnntlrygvynsssqqwvygda |
| Contig40_gene_975 | 133 | mdkvgiigagslgtalaqtvannvdtvylhlrreelaktinstgynseyypntklknniiattdmndlidckiiflsipssafrstlen lkevisedtilvttakgieypslksmgrlieeyfdenfvalsgpnfaseivlnlatvsniasrssenaikvkkvlstpefkvkliddvv gleicgvikniaiangicegmninenaryavltkgfedtgriieafggkistaseycfgdlvltstssesrnhtlgmlyggriivde kasgivfegknsimaikdicnntntnsvvvnfvydvivkqippkiafkdlwnniee |
| Contig40_gene_976 | 134 | mmsedsilltiksftdlqteinntanggililegyykynsnldsnflqkgvlvknitifgncvidgnntsslmeinannntvkiydl nfinghqntwnygrvsitnsiayfnncsflnstngyygsvyiaktsqahfnncifnnyakfggaifnnnimyckncsfennsaqsggs lcingengventnnytylencsfsdnsstahgaviycdewskgcfnncsfeknsattsggaitidganidinncsfnknktgtsstyn ggaiwiikndisgasnvnlntsfnnsasqdggaiylngtcvlkisnssfnnntatryggsirnyqgtataylcgflkssdatygtit kngcygp |
| Contig40_gene_982 | 135 | micsiqacsasctavyvgpdvsadgstiiarcndhggvwgnhitvtprvenkssrlmavcedgsvktelpattykytatpymnstka |
| Contig40_gene_996 | 136 | mkisriilillfvvffeiglfssytivnaevpnpqelwdmqvntvssffspenvgllikdpdninvtnkydlatelaevaevdgvnv enmtittsadtdeepfnatvtafgystpkgnsgsivisgqpdykivasvqikhtingyeadldtiniesilkvydsndaknvsysgyds gpsgasqsysysdsdsssndnayissdsssgsssydsgasssgsysdsgassgsssgssgsgdvvinllspifsfi |
| Contig40_gene_100_8 | 137 | mlilisflislllaigaasaseditdtieapaadevvtvdseiqeietvdnnleeietdtnnieeveaaddevinetaeteikdeteit detliseekvqiandekivqdgligfsinltdllggesssInlskllsgdnlnlnskllsgdnlnlwsellsgdsftlnwtdllggd sltvnwtdllggesttInwtdllgrdsltvnwtdllgedftlnltdllgrdsltvnwtdllggdsltvnwtdllngdsltfnwtdllgd nltlnmsslIggesttInwtellgdnltfnmssllgedfnlnmtsllgedfklnltnifgdnltaifgenltnkleelfgddftlnmtd lfgedlalnmsdifgddsifnlsnllgesttInwtdllgestInwtdllgesstlnlskilgesltlnltdlfgesstInwtellgg dsftInwtdllgnstlInwtdllgrdsltvnwtdllggdsftinwtdllggetltinwtkilgndtsllidnitslliddispfvdnltta vkdlinkflkeektvsvinyedmtttafdskidgrigkyfvvkltddkgkalsdkfvqifngrliynrtsdengtvkIqinlgykgdyt faicflgdektngsfavakitvkkqkakltgaasykasaknkyisatfkttagspiagkkitftinkktytaktdakgvakvvsitn kgtyaftakyagddtyatitsaskkltik |

FIG. 7C-101

| | | |
|---|---|---|
| Contig40_gene_102_1 | 138 | mklyknsiiillililsigaaavendysnadlidisndfvlsdnsneilidssgsldddssalvsegssngldsyysndivlndslss rssviedscsidsttiedkaleklssnelaegtktytdllkdiksaknvlnlkydyiydstidkslkkgivltfdedyeltingnghi idgngiaggfnfengefvinnlsfqnckisslilltscdfttnyvtfsnnydkssgacvyldnsyfysshdnfidnyapsgsaiygecsv idvydglfesqkpidwsfiygwdeteiyiedclfrntvsnystavygdyileisnshftnlfskftggaigvrnasltveksefnnvss lrnggviyadmnvdeekseetiikdssfvnsksdfggavlqlggklkiyrsnftentanyyggaiytsnvsfytskskfsnnvanemk gsaiyfdngdlkiensnvlsnpscegaiylydsfynisgstfsnndvaihsffdrtrtvknsktgksttvksslnnttwggdrnklnnv eypyfvsnlgqdiilnpvkinatikdkyfnlvdglvtpvkdqgdsgacwafggaaalesailkatgvsldisenniqsagiryslygk pslteggydytalayylswlgpnnssideydqfgkispqlfsednyhildviflDpantssikdglikygalsasangadsdndffne ktyaqycnddeasanhiisivgwddnysknnflitpkgngawivknswgsdwgkngyyyisyydeslrscyavayllnntlrynklyqy dltnyddfddgdydgviysnkftsngddliaavgtyfeyeddyvisvyvngkkayqqkgtsafvgyntiklnkyiavnkgetftvais ssampyvddtrihlpkgssfltvdgeqidlsqrgqiacikvytfndtkitrdqstyygsdkklaieselegttisltdsnckslgsakv vdgvaqfdlvlgpgtyfytssyagekiinsfkvfstiggvsnkni |
| Contig40_gene_102_5 | 139 | mavililifslgtvaasenividessdsnividhakdnylfngpikdnylssssisdnylskgvlddsylsrsdlddsylsmddgkgsi dltnhnqlsnsddkqlktsnledekqlesvnkgdkllkdsndnvdlfinmdvktsltnkqynragsevpwiitvsslngtsyntqvrdv lsenlqylshnatmgtfdpengiwtvgdlessknaslliltrlkrdgtyinkayattdsndvnllnnfliiisirtgsskitsnitetsd eregiqhnvhyasmvdtdfiyryeedsseddgneegsegnshtktrslgnklklfnaqnidyhslskniggalgfgynsnggflnsk diyealfvydytripiivfaaflvvlasivgydkvkssk |
| Contig40_gene_102_6 | 140 | mvlvigtisavsanecandltmeisddniaidsssalegddlaidsssdlsnenninsmndsvinsnsinsdsinsdsinpnp niddeinnhkdsflkavqasktgtftelqtkinkaskgstiyldknylynddfkgkygivinksitidgkghvidglkksnlifindas nvvfkniifrkgddengainligsdhiefnncsfnynygdrgavflsgsdyssfvnckfnenigengaliladsdysrlvnciffgn easdgavfitysdysyffnctsegnsvdytgafyldysdnssfidcvfdtssakdggafylgdchnssfincsywnnqdyygavcy ldncydssfiscnftgnsgsnpeldetpsiggvfyiseshglyfthcnfseneakndggaiyasdsdvhidssvfeencalcggalya mnsdifidsslfessvgdrggsifanksnvysknssfiqyyeiedeyyvipasgayhlmegniggaiyslqsvlnissnkfnnnfgits ggdiysysmiyiddcsfsnsfsngfggslfnndyvqitdssfencssrdnggggiysinsilncsdsdftncysyfggsicslntdl sinnnfykssaeyyggsiyflygtldingslfsnsygyggsiyirspqtiknitnnqflfsggirgpriyidqyygeisnsgnvytd eyeekglfsdygmgisfesneglvplihyypsneslpsfygpgrggdseddyededddsdiavdkdqiggncwafsgiatleaclekvt geefgsfsegnaknlmaissiyglnidtnnggydtmflaylaswlgpiyeeydtynplsslsidlpsvfhildidflaprknsldndeyk raimnngavsvtfdwvenkvsngfhsvsiigwdddyddidslgnyakgawifknswgyewdggfgylsykqlseeiapymhaytfsf kendigytdiygydfsglsdflilnstnayyknkfiaedneflya |
| Contig40_gene_102_9 | 141 | mrnpkdyimktdylilmallilsivspiaaadsfdfdipegyhienasddfvllenedysisisimdnstdrktlmdmlerhrcydf rngvnytkgdfyieekpyyqefqmgilyfcengrdlvvidykpglgmdlnnspidgildsfkwvsy |
| Contig40_gene_103_6 | 142 | mnnkkifvaglailaivlmgsvaavdmgilsgsptkfsidgidfnipggyavtdnytrvndtdtagssyrvtqatfennvhdaisvlv adydhdmseediisrgnktttingvdgymqtqgdyttfnylvdgnlvltitlnadllediivgnqtdd |

FIG. 7C-102

| | | |
|---|---|---|
| Contig40_gene_103_7 | 143 | msedigindnngaliadvnfaddnnnalkaesnsasqndasidesanptqdlvdtdnglnqsitksplksntgltvtktidnssnhmpv dgfydigdtiyytinitnnleesignisvvenfpdgliweyiwfaddnpwknesnvfnytkalepehsillkirmtgnktgtyintin vssnltssqeflseevtvyapnltitkvandpivtigeianftinvtnngnrplsnlriyedpeeslflneftnisgnwdsfanrggdy gfsldqldigesaaiivsflttteignftnnvysnypnpqveanatvtvvpriektvnateidmgesveynvyidmtganklgiddfkik vtdilneyfdldkdsissnwkynrdekafeymlsdipesfefnfavyitergnytntvslkigdlpevsaesdvthvrisdaniaetal dstvnlqeqavfivnitntgdktfnpyelvvnddyedaltylsheditgkwienietdslsftlnstlevgesasfklyfntskvgsy snyyinindkeddsivivlalmnksvnsreidagdsveynifinlsgyygpvkvedlfndtfaldkdtisenwhydetenafifdlsd npdtlnlsfnvtinekgnytnlakllilssdypeitaeapevcvykpdmtvtktvndteiyigdtvkytvtidntgdrtltniivkdeld pafildessitegwtynkdnssftynnnisvgesailefiveiskegkytnivnvsspgvankearseetvaktiptniclenvtadpd sfvriiinitadkgliingtvnitfpdgtneaveitngigetvwyvpdnyasgnysvfayyegngtylesesegqnievipyyteislsnv taypdsdveieinitagdaklingtvtvsfpdgtnktaeiingtgnvnwtvpddykgnysisasypggnyldsnatanieviakistq itadipnaypgeeidisvnvtadndvpfngnitvnlpdgsketve |
| Contig40_gene_103_8 | 144 | mdfnnfkyldelihsgakeinldsdiilledkeeqkysdgiklnidnlvingnghiinakektrifystaqnitiknirlkngtntigg aiynlkgkikiieatikengskyggsiyndegemeliikstftknnaksnggaihnykgkmsieesiinentakggaihnyrailsien ttlrkndakdfggaifndgnelkitestieentssggaiynnigeiiiknstitkniakiggaihswnklslisstlnknksyeygga ihnfdgeifikdsiitenisnkggifsnnkykyittstiennesdniheidsfldmd |
| Contig40_gene_103_9 | 145 | msksfrdlelliencddeivldsdivlgdgepiyleginldsdviidgnghsidacgkvrifyssgeltiknisllngysdesggaiv vdggkmdiidsiisgnysaddgaihieegelalinstvkenkakefggainnwdslkivnceissnearfggailnndgnleisdslf kdnkadkggviynqdgdfsvektlfeknkasadggvfynencdisvieskindnqadkggviynngvfiikdcelinnrandggsivny eaelnvmgsslsgnlsnyggaiytydgemsidesrfddnraecgaiysekciwdvsnsefnsnkaknsggaillkkskyevdnvsfrd nepddvsnf |
| Contig40_gene_104_2 | 146 | mdfreelnkilksddeennlkstenkikdkkednnlkpidnkikdkkednnlkpidnkipnenkepkektpqktdeermqnrpketi dhlkrfkelnttttdsifnispyvliiilkdgtnitdwkeiedkdilyisedlsgesyisnkyrdlegmrliiaggitskvqfiesmfa dckslidvigletwdtsnllslenmfggcssltscdglryldvsnvndmtalfndcyrlndidslkewntsnltkmwsmfagcklskdl rpisnwntsnvtnmtslftecesindingirswdssnlkdmgsllwgcksltdisalsnwntsnvrkmgrmfwncesltdisplkdwnv snvedmvymfvnckslkdltplsnwkpskviimrsmfdgcssiesinglenwnlenvttvermfdrckslsdvsalkswnlsndviagg ifnecpnvkenplkkeikdknkplhhidlnikfldliygtwgclvklgdiysrasyitdvpydclssivnaiknednfhvdfngegwtfd veadneqcyfnfhggekhafdtmnkydlaivyrnirdnlsswkgwthrdlsplinelcslinenedn |
| Contig40_gene_104_4 | 147 | maemtirnsiiennsarnggailndgnlfiekttfknnlaftagaisnggyvslkdvsmenniavtgaafinggdakiedsfiikniai gekrgmngehdvggavgnsdnlllkntsfinnsspfgsaiynlgidipklkylckikiedcrfennsshisgeihneigeisiddskfk netakrgsviyndsyltitscdfkdlkkivhnfnlmtihssnfesnqsdsaviendgeigilsiekgkiannisdyttvynhgkdcnit gtifennhskkenchnicnrsnmvlkeiilkdktvsiifnegiltaekkyknfifsvgkvfylgmenefnfsyldelihsnisdtisfde disllsdefdfyegggieldrdnmvidgkgktidasgrsrifvtgnnitlkniifknghafdnyfmsnneggaikvykgldlkiencnkf icnniseskggainnkghltisnglfesnksneggaiynhqklsiidtcfkgneghiggaiynkedleivstkflknivkeslfkarfip ilqledesfggaifnkkrmvikqssfkknmglddtdgawggairtigdeevtiigtefignylkdsnfggaissyktpnlidctfsdny pndln |

FIG. 7C-103

| | | |
|---|---|---|
| Contig40_gene_105_4 | 148 | mgfidklkkgigrknkeksskrdtqkdtglkrksppidkasfdgsdeeyklfesimsyrdepvvhsilrkisddrllieigkshpflel rrdailkikhasredlielfdlnedrwgiglrnaiaskftkeqlmeinderklreiirysneenanciydkindeellidivcltryes irdkfverfkndpevmrrclessrspelkskvaqyinndkelkkyilsqndwnntveyalnemkdekianealyefahkgknqlnksie fmsddetllnialeyynldydryyfeigmaldrindsllvdlmhnetdetlrrlaakyikseealkefvndpnenvrkiairatckns ldkfmdlfnndeiilddhfildgdiyetitinrdnvtidgknhkleclnpkielrieannfsikniethmlirlnegslnisnsiidk sieinegnltgenstfdrrikningslnltdcnidqifnesslslkgcligsiknddscnidnctineflynngrckienskvesasrn ysnpydggaisngqnasmeltkcilaknstdknggvirnigsinlydcifednkaglsggaifnegrltasrckfknnlvefprygsf sratgryhfikhgnsilnlafmdlfncqfitdkindapeliaqfgkdsylniencqfstnkktsvdaieglnfnnakfkvsfddveei nlanegpeetgsinknlketsstneglkerrstnkglketssinkgeettvssknedidaesilenfkqfeylddlindqsseitldcn iqmheleqafyeggieiyednltidgqyhtidannlsrifhitgngivlknifkngyyyqdyfdnskdgggvlcithsasakiincef snnesrqsggvvknnsdsleiidsnfrdnkviyqkgciinnasltlrncsfknnfsnagscvfnsedsslkifdcefnnntsrkdfea ggvrfslevpssggaianegsl |
| Contig40_gene_107_3 | 149 | mplrvavayifendidyhvnyqtdltclagfdqnytiysneftskydeligavgtyfnesgikysfdifvndkkvqtqngtseyagfrt ivlnnyipiksgdqfkvvfksnsvpyqawsrvhylngtslvsadgstwtdfaplnktvclkvytlndttkladandmiieyegedsyfsv raatennisvgpgeevtftinnnttvktndegvakikiseapgtykitssynnqsyennitiisrertstrilyqnmstvavnskvdg rigkyfevnltddegqplnnmpvqigfngavynrttnatgvkqinlgyegsyfaiaflgdnkyagsfevailkvskqapkitapak tykasaktktitatflsdkghgvkgkkinfvingktytgttndkgvasvkvslnkkgtytctakfagdgmykatstnfkvkii |
| Contig40_gene_107_4 | 150 | mektmkskIfilliiiisillisissvsaselqadasnidndyqtnmefdpicndesnqndlnIknnehilkeentnppeiedetcftt lyqeingsddelnlthdyifnksydnaslyqmyygplisvnktnftingnghiidgnemgaefdfennkgeivindltfknfnqtvlqi ygkltlnnvnftesfeslesiifvskgvlnvnncsfysnraknisgsgsnitvnnsifsgngnyeraisanrwqlvihnsrfenftfk ngaiidfkgyyldlenssfnnihsnisggailgkyfpayikvanktqylpsdpmiikncrfenisclndgaihfdfdsgsqriagsln iidsnftncsskyggaisilgglnleksnlinnyasfeggaiysswtninitdssiknnkaeknagaiyfdkgnlsikssdiinnsal eesptanaiyahdvaadfsdstfdnggiavyadfashsnftvnknddiflmdnhnyivsvetpgiklnltnneiivdslpskfnsqd wgwttpgkvqgdnddcwafatiasietgIgkstgvlynlsqnyvqklqlkyyevgdlrnsltgfitsglgyalswygvlptdaayddrg miadsdmnvprihvqdamfiytgenntidqlkkaiikygavtvqywayregeeilsegedisimet |
| Contig40_gene_108_4 | 151 | mdkkifivsfillaiftigavgasdvseltandlddnalsIndgedllagdesgesgkesyfnndnnyndenrvnannldygagndas kdkvlsdnvsdyiyattlsvsvddtpqsqyptatvslndlsgnpvaeasvsvsvddgddymtvitttdgtcplsIdnylsvgshkvgaey sgdtygpssasttfnvleeyssylntdlfiytgtgreggytsvtgklthinqpisnatislyvdddfysnlttdkggeiegmlfnisv grhelrgeyvgdrgfepsnatkyfnvlpkdsvssnigmtlnasdaqvtqanayvllerqyggpmedatisisvddvfymnvttnalgy affdlsddlsvgshklsgeypgneytgsssasitfnilpvddssynftvteyanyldtnttvldissskyyvngsfnvsvvspngtlstf tqdcspdghnnwsmadfgidgigsyiisgsliifknetlithfdnqtfhaicirpiymesteannpldilvvynssdatkvsvngsglfeg rkitdgpivwnltdlnitelgdynisvmsydskgnlidrfdynltigpngddyklyakidpnsystddvavalycpnaswgndievhiy mgnplevltffpdsvsspteaasfkkytladlriensndyrveikdfalnqfpgisfnikvcysnmilvsgngsfeidfdgasvnatltd sngnpisnasvsalvngvesncttddngnlliipfegnttvkltyidnngveikgtgkyvkesviknrtetkiiyqnmtttvnsnvdgr igkyfevslqdadgnpianktvfigfngkvynrttnstggvslqinlgyagkytfaiaflgdddymgsfevalitvnkqtpkitasska yrpnskakslvatlksakgnaisgkkisftingktystttnakglatlnvslskkgtysctakyagdgmykatstkfsvkia |

FIG. 7C-104

| Contig40_gene_108 8 | 152 | mmkmtkknlflislilliltigavsaaddlsassdltvedsgeaiatapeesvlinenngdsiadkglsdpisnetaniaidekttnd kaiseednsiyskdkanvlrenetpviltinapniyygetanvtvsarygagplanssinlaldgaagenilifddgiaqknytglaag nhavvasfsgygypsasasksfevltptvnieieandiyygerayvtlhvtygnqpfanntiqvsldggsstsfiveddgniqvtysn lalgshtvsayfsgygypsasaskdfkvskketavslsvsnpqldkgdelrftpsvlsngfyvmansysimvdgmsnysywtengtyf lstslssgnhtltvsyagdasflpssanatftvnsykatlslmmietelypgddcyifidlydsnthqsiaanitvsvgnnsylypir vnssfnlptdnlapgvynvtaffdgnglydpetavgtltvlskkettlslsisnpvlsigdelrfipsltgdgsyiwgasytikvdgmg nqtcrlvndtyflstsdfaignhaltvsyagngeympssatgyfevtpkkanlslnmlstelypgddcylylyltdsnthqsiaaniti svgnnsypypirenssfnlptdnlapgvynvtafypgndlygpetavetltvmeenatiktetylsiimasgdkylgdnipfsvsrtps gvslfgdnyifsidgvesqdifyenfsyfivtenlslgnhnltayypgdemylpssasqnftlisrpksdvllsieandtfigedatii inmidelgnpidganvylymdnkefalplvngvaqfsysnlslgtylvsalfngteyynpanasasfevlnanltvtkdnffqffnnng vlntnatdlkfvgefndlgitsikinkpvsivgenaniinipvivssddvslaniafayngsepiiyannvanleiinnafsykspsdk syavnitksenvtiidnsfnvvggnntyginidaigfeidsndiy |
| Contig40_gene_108 9 | 153 | mvimnnkklfivslilliltigavsaaddglatsdeitvddssvavstasaesdiyetngdivadyqsdsisnvtvdddntkdeiirs spakdnlllddddpgavnddegddedyldd́isvsitneydvtdqdavivslfvpdveegedgiegyfvvcldddeiflgpfnhti tpddygtdvtftasdleiteaanywrvfyvsdlaeplidndeedgynmifdgciardytqfyvivppdgrisifdtsaiytvcppg segtvtltlrdeedvetsftqeiedadndenqlywdldymglntidaagnyevtitlengtliceddirimdpieipevsyinstdydha tlvalikipselddleelidgtvilqiddetvfektlsefvegespddpfwvypkihwsdeldtsvklyvlnngldidlepgtydvt vkldldgwdevssteevrlvesnvvidedigasieifdqedilndnevriiaitvtgdksgrvnlavegcpewecpldelenegdiyyl nsgfdiesgehevvsyvlnddrsvsnsailnfivyprificgnggediivnyfadedsaihiypkgddvstirivvtigdevvldstid dlglspkindwgetytvgpanfnkklefghyepvvayysdayelstedgelsfidiiigmvhvadieddetpvlavcsdrdgqigvyi rqytedgdqelepkyfevekhgfimptidqlgldeggyhidvayaddewifgndlivvnsseyfvlygcdwlyteesvyvwcpddaeg iislnndgtinvdheitdedkgkyveftleelgispgwyeisvrvngneidhigfdvpspiympnynvylpeegyepdysmiakle lnselegnitinldgtivfnkdiedmeaikdgskwiytiytsdldeaeegmhdvtvtfndlneersieflnrttesdgnlsiimlggty cinwndviaeviaptnyngrlvlrlqgeimqswdelhwvnwdnyn |
| Contig40_gene_109 3 | 154 | mkfknkrgisaislillflsismasaieisaddadmdsgdlsvcevstsdcygetlisadasgadssdeiiinetiadektdyrssil adgekknlhvevsndvftpdndyefmlydedfnqiggyldiylndeltysdftvdssessislsglecglnkitfiydeddvynrlnq tkefyiygenpefvmiphydtitlngnyssrvylkeydewgyydednegdiepiddkfnvyiykenpgdeyelwedefeangtinfdd aikttgnylirlyfngssdysyapynsnniircvnvitdfiindtyfipdkgfsvylvdnatgdiidkefklmvyyildtsnpvriv eeemvkgnktytfdcseipenitylfigcifdgdrdeyssadkeyaleltdsrietsinanigdsvignssfrvyvqdeenwqidat ldiylneeysqtvtayaylenevlienlkkgentlrivyngtdiyqnseksynftvsdkranievdvsniivgdvtkitvnltdedgni lnkefnvsiykggsyydedseliysqvytgsanislpdleiddyyvraefvysqaedseyfnvyskgsyidlgktywpdnddvv lnislrnyleeningevlfqfngtdyplctedgailnlgklpvgkyqifakfdgdgeyeasnltdqlrivkatiinveacdvlkggse tvnitftdgdgnpldvkmldiniwdtdgnwldyggqlrnsieikniqtdyiiramlsdsygeigsdyypssaygfirvlngtdptvitv tntanidlaidgpkviitltdedgkaisgaklnaavgnmesilttdskgqavlaigandtakvtytdengagvsasivnnvinttvtei veknitvpvtanatidlaidgsdvvvslndldgnaiasasldatvgttnstlttddkgqakvaigvnetakvtytdengasvsasivnn vinstvvinntvkrnatkiiynnmstvsvnsevdgrigeyfnvtl |

FIG. 7C-105

| | | |
|---|---|---|
| Contig40_gene_109_6 | 155 | manvsasdisaddsvsldaadsdivstdsisvdsvntysadsaissnedkdnyhpsnlkddnkiskinyelndtvfygddviinanlt dmdgniildeffqvtvydegnplqsnslkgkgtmivptvsltessyydvalsfagneeyascneftsfnvtfkensylaisnydsyskin stkinfiiydvddeyindtadiylngeyytsvltnqnenevtienlqvgentvlvkyngsniykgsedsatimgyekdtsigidapdvl igndarikinltdedgnivngrvdveiyeytgddesyvpfkddyvvngeailviyqsklragvtyfiradyegnltyfrsvgsdyfdc fnrstelvidgriasddkditleiglfdqrqvmiaglvnltvfdnesnvvidtisvetsaddyvnvtigklpyghyminasfegneeye gceleanlhvfkatnltievrdqikgesqivnfslvssdglnesaslirnmendliydglinftdgkasynldnleegliiladynn gmdivgpfetvydsaskfatvriikglngtiefepvndsiivnlkdidgnpiaeaplsvdvngqvfelitddngqamldnipnnvtiev kytdnglvasnkivvlvkeqikgraaskivvcknmstvavatpdgrvgeyfnvtldadgnplvnktvmigfngrvyrttnetgevnl qinlgykgsytfamcfldgknasyevcvikvsshqpkltgsaktykvsaktkaisatfktsngnvisgkslvfiiidgklynaktnsk gvatvvsiskkgtysctvrssddgmyaatstkfnvkiv |
| Contig40_gene_109_7 | 156 | mfiIkfeikrslifisilailiIisigmasaseeisdsvstdiasedvtseigtdnveitnledssidddadlekdtgdkvkkakkrint kilyqnmsttavvneydrtgeyfnvtlvdeddkpvvgeliqigfngriynrttdsnggaqlqinlaysgpytfaicyigedtyessfe vavinvaakmtltvpsksykasaktktltatlkdnkgnlikskqisftvngktysaktdskgvatvkvslstkktysftakfagdksf gavtktgkvtik |
| Contig40_gene_109_8 | 157 | mqaiipvkdnfIilvtnmkksdfkrificIvlltcligavsaaedvsvddvstdavavdtitedasdptdistvsepvsndvqantsqe lnkepatkstnvlkdgtstniyvattgsdendgltgstavaslakaveivnatagtdftinvangdyniskiespaaknvnligeskeg ailhasdtyginvyedniawtienlticdfnststsaavrcfaidsvfninncifknigskngaiyitstgtrtisnvliedcfgtys ssssiihlygegpvtldnieirgsymdpsvgtatylrsviyadqagtnvtlknsrivcnigamgslieakgafkvinttfegnylntss ngvnggtfmfysgtssnsasnidisqsvikdnvlaggsiglfncvygthnidhnvimnnkyangndvplgsfsgaaistddnywgtner pntkttewviltvdtpemafvgvseaipvnlntyktnnetgavegmpdvdfgvtyalnqanpstvtvanggtinylatvdgnetltf stgdafsfdvkadiasliyvdglngnatgpgdsehpyktiaqainvaadgkiiviksgtytenslliannitlkadknaeviidanneg riftvqkdairdltlingkstgnggaisldsgliItInnvkiynstaqsgaivslsgsqlsvsnsefidnnasnggaiyvagvaditn nkfisndpedgagaiyvagvadiesneftsnhatngagaiyidsennqtikdntftsntadkgeaiyiknanvslsgntmgendsiyldga slkttltflggktiaaefggtlnltatltdedgnnirggivtftangetiatidlstdcaglktqytvpndaagcitisgsysldnggav isgkihpavphwfieggsgyetladaidgasagdiiyydlpedyteviasktinkaltiknngtgvtldgnlcrilsissasvnlenl ifingatatngglliylsgsasndlnisgctfkdskftttststya |
| Contig40_gene_109_9 | 158 | mnfkklmislillfvlsvgfstasaidsdnlIdenninvnyidsdnscsililsdnsndaksnnliinsinkkelndnsnsnlec dssinenldlennykineksaglkdntntiyvsvdgndendgitletavaniskavslagegytihissgtyeqnkstqlshafnfige dgtiikrigtanaftytsdtkktisfkniifsttpnpsnpilsmaggadlqidncftdaiagrngliirylgsstgkitntnfigltg stsasssyitalagskvkvenctfaninepgflnslvyvnnnetnltlvncvfrnitgnlnavvnnrgymqikncsftdislsgnsprg iwwsseteisknsityinssvfinnsvntevvvnssviqaksptiveysafldndvvfiinndndtdvtarynwwgtnegpkncsvnres sassnpsssseekislvsdgvtvdnwaimtvdletsgliagedypiiininkymnergeidssveygisgaeillssqigtfnsdfiiy nedngniiqnqakvytnngavtvfykateegsdtlnisssgyeeivynlefgqsieyndciyvskdgrdnndgIsnetsvltiaraleige nlnsnirihigssyhesgfelngtyvtvqdgvlqvkrttysfigygnvviddgqnkslftvrnnsvsyknirftnvdgatyggaingd nlyrrtayidltinnctfddlhvkssggaiylnyvsnasailencviannsakkdsaaikisegtndvgnkliliksclliennsardelspaiyvekg aidisyssvvndlsiatrtyysnlygIqggvaiannnwwglsnpfgeneiggnysslggvfngsnitvdswviInavlndtgglvypny ivnisidfnhvnttrgeielIsggkipkeytlrlnatggivypny |

FIG. 7C-106

| | | |
|---|---|---|
| Contig40_gene_110 0 | 159 | mfligaasaaddavtlegdaaavdsisedasapitttvsedasigttfsdsaiesdsiqsnddlelknvtdvkqkdssdalkdgestti fvstgndndglsletavatvekainitktggtdftllisngdyniegitipvgkyisiligeskegtilhasgdygfdisygcnfenl tisdlnstsstsaairiimdnydininncifknigsaygavhvysngktsisnvliedcfatksddssiihvsgkgpvslndveirgsy mlppafpwstpylgaiiflssadpdvtlmnsrihdnngsiysiitskgkikiinttisdnclnasyasifssgvnsntatditvtqsvi adnilannavglldarfgvfkvdhniiiinnknangndlsvgdlsgassfsiddnwgtnvrpndktsewviltgdvaecafvgvcenik iflnsyvtesgeigvidgmptvelavgyalnqenpsavtikdgvgtisylasiageetlilstgdvfefnvsseigslifvdgsvetsg dgtqenpvktiaealniaadgkiiliiknqtykesnllvdkditikpydgadviidgdnqdriftvtstatisdlsltgnatgdggaiy lnggnltlsflnisnciasdnggaiataagsdlylsnsiftdnfaskgqsifiggeaeilmdfvahmdvlspdasfnaisintdspvs ivsnnfndngaikgqavyikdapvslsgnimddeiiylesgsvnsnlifmdgktltvepgadvnltatltddkgnlirggelftangv avgdpidisgdnelripytlpsdsegdiiisgsysfdnggtivngtiepdipywfieggrgyktlnetvenavagdviygspgtyiang ifitkdltikanetgdiildgngsrvftiknqatlslvnldlsnggseggfvyiyaeggnlnvinstlrdlnivgypesfeggaikty asstiniesshfeninssafapilsglggvklsltikdssftdik |
| Contig40_gene_110 4 | 160 | mkikksfvilcliiclftiasvaasdindttisdgdnlikeadgdllsleddnlikelneesdknllvqesdndnnpesdkdllvqes dndnnlesdegllvqesdddlnkkadgslfsskygdnaapikintsylikeinsylekdnytalkeeinnylkksnnaikeeiskyi lknsykalqkeinnyleennfstlikeinnyleennypsiedgiksylqsnnysslqdvlsdviskiinsskkesepiddgtftalqyk insapngatisldkdysydegfstrgieikksitingnghtinglsasriflihfgltgnnkvtlnnivfangktdlyggaifnygnlt vnkctfknnyaktcggainsvgemilknsnfknntaggdagavfsfkignstnifkdiykdkvidgnmdfiidyilnininygwdsinn csfssnvakgrggaiyafthikingctfnsnkagehgavfanknlnisksfkfktnnkapkyggavyfrchelsgsyvnktwvskmkyy tatikdsiftkntaskggaiyefnhtvsdkkrlkvskcnftdnkaslgrdvfsgscsnciyfyvkistksvtvkktaksftltatitng tkklknkvtfkfngktyttktnsngvakvkigkavikklkkgktysvqitylkksakttvvk |
| Contig40_gene_110 6 | 161 | mtvsvfisasfafgnvlsnadngsvqtynshkdisspnmdykhpgeliyggcggnqiqtdghicek |
| Contig40_gene_115 8 | 162 | mkvlkiaiimlililislgavsatenfndlsdnglndntlsdnslnentlsdntlsdksleestiiqndhdnlkdtnnndnnkalkdpa ktftdlqmeiinasdlleltddykynnetdnitltisksnfvingnghtidgdnqcgifqingtnitlknlniinanstkdsallnpg seletnnvtfindssdkrvifafgakytsnndkfidctslndgvinsylgeitinngyfesskpldwafvnslgnssiyvlnttfantt skyataikgdretvihdskfinlyanltagaiglkrieeaeidnctfinvssqknggaiflfdiysdsedvpimisrsfvncysefgga ilslggkitleednftnnngaffdggaiyssfsqltisqtifdnnsvelddrgsfggaifsdisaliiincsfsnnnagtggalytyds gyyianstfkdntnkesefddiftdfdgeiatlennysgedsiclnneryesviavsgmnftlieneinvtnpprkfdlrewgwvtpv knqgymgscwafgtvgaiessilrflglemdisennmqdsllqyyrygtlgaeeggeynlgpsyalswfgvfpseydvydelgkisaii atddsihlqdavfvpplmnstdkdklkqsllkygalavsyyaetdepglnentssqyslkndsnhrvllvgwddyskdnfymtppgdg awiiknswgeelgdkgyyisyydqtspffghtiqldsyvpikegdefdvkitsdcipilesgrqhyienksaanlngewdltsdgkvcaikvy dynieiyvndelkysqdgretvhdnelkysqdqtspffghtiqldsyvpikegdefdvkitsdcipilesgrqhyienksaanlngewdltsdgkvcaikvy ttdedkkkessrintridcknmtttavasedgrigeyfqvtlkdengtalankpikigfngrvydrttdengsakliqnlaykgtytfa igflgdeeylgafevakitvkvqtpkltapnksykvsaktkslta |

FIG. 7C-107

| | | |
|---|---|---|
| Contig40_gene_117 6 | 163 | mnfktkgslililsllfililigigmasasedintdidtdygsdsidvsdvslndeqiasedslpnyeianskdklydegeeeggitnd dddenyridgiyadytitpsengtifvegeriqiifnftdqdyepvsgdwfinfygestdvdiyhpfeatgltdyvvpiylppgdyvif fyegvvfddfggiedegtqldvtfedaegnqldnpefsirtnynkkvyanltidysvaelenlvegdditakislmdefnnkmtekvnl eiyrngenydskkvnvvegnnniifenlqegnyslevasidsvpkytniitkavnftvksnydpdnyqiilnpedekklvgdsyemgv klnpseeaeegsidlylngnfvktlelnydedgyshhiveglqlgpnnatflyqirdgvnvsesvnliryetesiidlessdiiigdd akikaslsyldgivkkpinenfklyiknyvededevefvydeeftikgsetitlsdleegtyyisavyngknykylateeestlevfpk etrvdavartysteenvivgieladlsgkaikgtvnvvldnktsyqvnttddiqhpveldiglgyglhnielnytgddsegwlpsynn aeflviypsfmsiedgdvtsgsdltvnisltgpddegingiitvriydntgkylingdfnttngvksielknitkdyiiygryygldts kieigpsnhylsseaygfiriaegksekteydleltkvndntviaslkdsdskpvanaeltvkvngveskaktdnngmanisfsgnssi kvsytdannttakasmeiiiinnvtekivnqtvevpveiekivyvnqtvevpvevekivyvipnrtdtafeyenmvttavasadgrtge yfnvrlidatgkplaykpikigfngvvydrttdadgraklqinlgykgdytfaigflgddnytgafevakitvklqkpqlstasktyka saktkltatfksehgntvsgkkisftvngktysgttnskgiasv |
| Contig40_gene_119 8 | 164 | mgkfkfifilvlalfliccgiaavvdapdsfdgslnlipvsdssvsgdssvnqsdcengtcsvdlnksednssketsddeidydskyyd dslidglyfcndlehafkdakqhhknvmiifdgaaciyceylkdegltdsdiqkeinendillmtytsdspelsqkleiygtpttvifd engtelgriegyespeqfiselkeyngk |
| Contig40_gene_121 5 | 165 | mdskkilmiavvaliaivavsscsagfldflggdnatddslngkevnlaaaaslknvyddelipmfeakypgvkvtptyassgdlqtqi engletdvfmsasnkqmnaladeglidndtnlqflenkvvlivpkdsdinitsfddlkdvkgtiaigdpesvpagqyakealtnlgiwd aveskfslgtdvtavlnqvaqgsaecgivyatdaksnddvkvvceapenslntsviypvamikdakdadaakafleflqtqeakdkfve ygftihe |
| Contig40_gene_123 8 | 166 | mklskyfvflliicilfsistvsandndmsinqnlqndanqdinqdlqlneayqsdtnlnqnlqannqendllkasedktyndlyndi kncedtfnlendykytesdnhtfisinktnlvingnnhvidgsnkaggfeflkeslniiiindltfincndytivnedggnislnnvnft nnhnklgilysegmisvfngaltinncnfdsnmtnliytnfaelritnsnfsngkgigspiyanrfelyidncsfenftapyggainf kqntfviknskfknlnaeitagaifakyfpktnkdgpyipgedmlfencefsnvssthngaiylnldsssegfaktihinncnitdas sdfggaiasqgeildfsnlniinchakiggaiysswadlslkdcnliinnsadkdagaiyfdysklliidnsnftdnkvvnlissqkesily andvdaeirnsifdnggvavyanfasnskfenntstdliflwnntnylvsvenkgikinltnntinvdklpskfdgrdwgwasplkfggd nvacwafatagalecallkqtgvlynisenniqnlqlkyfsegdrrnsaigyaysglghslswygaitseddpydergmysdvaetdkr ihvqdamilfggrndtrnlmkeaimkygavsiqymyapydytanytevdlqpghfvtligwddncppekvntkmaidetnippgpgawl mkdsedsklgedgyvylsyydlsilskdfypvipqaagvayifentndyhvnyqtditglagfdenysyysnefvskydewigavgtyf nesgidysfdiyvngekahsqngtsefagfrtivldkyvpikandtfkvifksnalpfgaysrqhyipnmsisadgsnwidyadknrt vclkvvytiesdkenissrastiidcknmtttavasadgrvgeyfvvtlkdqngtaltnkpikigfngrvydrvtdengsaklqinlayk gtytfaigflgdeedylgafevakitvnlhspklsapnksykasak |
| Contig40_gene_124 7 | 167 | mnysiiiifilmdalvlmasiqvcgacgkgsnplcvpmvm |
| Contig40_gene_125 4 | 168 | mkfnsrvlgilslfvltilvssvgaaeykltekdfnntfkigipegtdfqgdaysniaagnvnfamkvfdnignntgvvsvlyfkds ssdsnlisdviddlnssgevveendnyiivknnydaewnapdastssdefwsfigdlcssgsdmnfgdgdsnihlsddgvniedssanv sfskngiyvsdsdqnvsissegvkvsggsnetvdvnadvdsvmnsysefadyslclknpkkdqlliicgndldllkqmadsasfk |

FIG. 7C-108

| | | |
|---|---|---|
| Contig40_gene_126 4 | 169 | msnietddsfisensissdindnslineftasnqiindniaindglskgdksqlseeksiyvslngsddsgdgsekspyqsikhavskad ddsiiylssgtyngennqnisigkslsiygedstiidgedkaglfimnssaklslngliltnaykdgnlsdyggaiineggqltiinst iknsygnyyggaiynnlgrltiinssilnnsaiqyggaiytlgvtniqnsvfekntltaekgvgasiaaggtitlnntdflnnhaiysa aallslgnatinncsfingttnytagaisnhgnmfinnslffncrvrfyagailappsghvvtevyntifdynnagnhgavtnnfqda eitmincaitnnyiqknvfygdialddnatvgycwwgqnnissyyysphsnnedpqginasrwlnmtftssngnisadevntltvsikq yfdndtkeiyeynedinlpltvkffddnkktiatktlkngtasynyipvkgvnavyaqitneiieipvvqkkesnlststnltkyyknes qleakltdgdnnplsnktisiellgktynkttnengivkqniglkpgqytaniiifkdpeyknknitvqitvlknstsisaknlvkyykn ssqltvklldnnkkamkskkvkftigkntytyrttnangaatfninlkvgtynvkvsfggddyykgssktvkvtvkttkmqakstkirkn snfvatfkdangkviknktkvkftlnktkytyktktnskgqatlkvsvklgsytiksqyastktygatvfntkikvvk |
| Contig40_gene_127 0 | 170 | mekkttiilvliliialiacgvgitlfaspssistdgnttitdmanrtvnisssvdrvvatsppmttivymlapeklvgvnfqwtdeelky vpdqykdkfpviggwfgsqdgnyeefiasepnlviegidegmgvdlstveergekfgslpvvavtdntnvtkidntieflgkllgaedk aneliafndkylsqvqstassipdsekksvyyasgedglstyasgashqlislvggknvadtevkdsgseltvsieqvmswnpdvila tdedfynkvyndskwasvkavkdhrvylspqspfkwfdrppganiiligvpwtakviypdkysnidmvgatkefysnfyhyglsdeqake iltssglkgsdl |
| Contig40_gene_127 4 | 171 | mknkslililitiisigsvvatdneeinmdninnidmnediaidndvdnsninnptdiridnsnlnreteldsninksnqir edeleqsnaksnlkssklssttvdgsdenqmsnptiqsaidsanagdtilitgksyvhchfivnkpltliseigtsmspcpsntkgsg ahgifyispeasgtvlkgfnltntygdyddyyiilirgaenveiinctintvsdgdirilenatnikadclikdsniginitgsskttv tnnitnnkvtgvnvginnndttihtnnitynqhsgidlysgdyvyilnnfighnqskssgagiyvnsnitkveikgnflkgnqqyg vlndyrvrnmdasrgaetleinnnnyylghterityhieyskyaggpftydsendlyvvgdgngdwdigktvvylgyafyrdetvcgs tlfkapsttwgtevykleispisqvkkgvysvsivdvngivasdissiyvtfylnknntdaepqsgdiyktvlmengtatvnltdkefk esgnkitacfpglynvtinpyatfdvndsdipgsyrnttinatdmslvpnsgnkitarltdengnpvageslqfkisgistttyrttd engeanlkvslsnpktytvninfkgsenynkssktikltvkkqtpkiessnidllpksgenftvtlkdannkaiankeisftlgkktyt rttdengqaslkinlantgkytittksektsqynevsksntitiktgankvniessdktyipksgenftvtlkdansnpiaskeisftl gkktytrttnengqaslkinlantkkypitttkyagddtyssasaentitiakaaaelttynrtyinksgqmfsakltdknniplenki sftigkktynrttdadglayltiniaydknistkflgndqynaktntnsititdeietayidkglkndeigriidekpnydvkflgds yddvnlninktlliytdvnttlngksaspvfnlrggnigvsffni |
| Contig40_gene_129 6 | 172 | mrstillsastaesrspslttgrctvqtvadgmp |
| Contig40_gene_133 1 | 173 | mllicfiglveailmalvdwedlaisvrksprklynvlkdelglpewnelsvierrsmkkryavirdsfpelppweelsvidrrshkrl yklikksvydgdyddspslegppaavgpqkeipleeaeyp |
| Contig40_gene_135 0 | 174 | mnkkiilslllvllvaisvsavaaadadvtyindaadvddvadekvapltasadagdiqtkldnakpgdtielenktydvdttfnvtkq vtikgqdtvikasgasqggsgalfianeagtafegitfintdqhknygeqvsgyaiqlaiengtvdnckfidwssgvyqkgasfcsitn syfngsseqvtnggkkeygtkainlmgshditvtgctfegvldaisiasnsgnnimtdntfidncyaiyfggastgqcvianssfirc gycvddkgnvifkdlpiistqkaangyiiadntieanegsifmkaesgntahgypskigdinitgntitataganpegitfmyilsnsg plnpyapiaivnnldagitpvtvwyadwdnengtvipaadkavtsiniaeiaaadgtvtvelvdvngapqagqtlsykiddgnateie tdengkavinvpidenataqtvavefagtndlaassaqvsfkntatkrtatqinannmsvvtlapntgdtndnyfnatlldaegnplvn |

FIG. 7C-109

| | | |
|---|---|---|
| | | kevkigfngkeyt kttnengvaqlkinlgykggytfavaflgddeyeasfgvylinvaaqtpkltt kaatykasaktksisatfkteqg sviankkisftvngktytgttnskgvatvkvsinkkgtysftakyagdntykavsasakltik |
| Contig40_gene_135_1 | 175 | mslsifvlviggqffinkrilllfvfliffisigsvvandldsnsvnqdnyisdvdsfdgsnsvlsssnldssidkdnylnldsnnnlnl dsdknsvsgsdlnlnnadlinsvsgsdlnlnnadlinsstttndssnsnnsnnlenltnlddskgasnqkpqkylipndssigsayiqki idnaapgstiqftgsfykniylkidkalniiisksgtvinssyrlpvftisrggsgtnisgftanlansfveasdvsdisisknkiftkr kaivlenvfnskivrnsflrfetaidisksggltisnnnitpdngynvgislkdiyrdkvsilnnnitghdrriestgiyfgpnaknvl iegniidewytgvdfpnsvnnvsilnntlnhngdgviingwinnftfnknvvtntgrvgvlfdydfygtkgdftleknfftqsgqldlr ntgdqavtigenfasrrcvrvamkngfsiktrqngnyyfsivdknsrgvsglpnfsatisingvsynvnfinsvayvevdgasgende vlldvgedkrklsdwgetqnlsssemeyykkiyddlliksmveetnndnqdmkkvedkngtstpsggnggdsgisdgrssvssngdss pasagtsnvaassasssagpsaaqadtpesstvksIsIdeetfrvagvgglvfliicviglyyredimdmike |
| Contig40_gene_135_5 | 176 | mnnkkiimsfllvlliaisvsavsaadiiadnqdsissndnsineiatedisdkindksIsdgvstgnnwivkpstdgksdansiqka inldntkpgdslllltdknftleksvslnkdltinggniynqnnltdlfiiidpkseggpknititnvtfyvngneniviangenyggttyi dlanikisnctilpinpdsnindtvlniksdrtvgtggstgfvIvsgnklngintlknndyvlkddfviqkadpilntalicpnmti ttydkntndtpsyyevklidqnvnpvinrtigigfngkiydrtsdengiakvkltlaytsvytfavyflgdesyasafdvstvtiikn atitpktvsynvnaktktltatlkdknnkalankkvtftvngktytattnskgvasakislskkgtytftaqvlqgtisiiqfpkkgkl tlnplstnltvkkytfkkaatkkiqvtlksgktvlkskklltikvngktysgktntkgiatitikltkkgtytytanfagdntykaisks qkvvik |
| Contig40_gene_136_2 | 177 | mnnsadngaiyfnnqnfgqnltinhnifInndavaiyfvrndsasnadynwfgnnatncdiaptsnnmemntwlflnatsepegisld scdiifklyayapsgvseydssrlkeinltvtpngrinttqaklgekvhytpesaecmltasienafyttrlkisdgttfrdlnnlin rndndtiildndfiynslfdskfknginiinrpltivgnnytidatgmarifriqaddveinnitfanakidgngaiywysgargivsd csfvnnsakmygaaIywngangnvsdcsfvnstvtdehggaiywhgangvvsdcsfvnnsakkyggaifwnaangvvsdcifvnnsaks ydggaiwwneglngaisdcsfvnnsandggailwneaaggtvsncsfvnnsanksgaaiywdsgargvvsdcsfvnnsanrsgalywfa ndgvvsasifvnnsgdngvlyfnntnkrnlsindniflnndvvaiyfvnsdstsnadynwfgnnasnfdtepltnveistwlflnata dpnpveilnssdisfklysynatgisdydnsqlqpvnltItatkgdvdsiaklgetviynptsltgsvtakvenvaysieinniksnp nlsvesdeltygnniaialnyesaatgkvnitlkgkksdytfadldlnetisigilaadeyeviveysrdeiytnasargtlkvnkans tltvsdiefdykdmgsgeisftnatgveakvinhdeaivfvrgntitvlnlsadsyilevttitdenhnevsknatitvrkvnstinvn divlyygesinlavttdgaigisadidgenvelnenivtipddlesgnhtltittvpndnhkeasktvnivdcrignitvvvdgveysi pavngtaittnmpeeieklkenitdltgqleeaqtnatnlannltianqivdkliaqleeaqanatqtindlthqlneaqtnatkiand qtnanqivdnltgqlndagtnatkianlenanqivddltrqlee |

FIG. 7C-110

| | | |
|---|---|---|
| Contig40_gene_136_3 | 178 | magstirafkvtasgvtiknltiknanvttddlgntddegaaidfeksgtieycnfinnsanaagavyfykdnskaincnfsynqavys ggavcfeesgtienctfvnntavydilggggavcfngtgnaincfntngnainctftnnkahdsggaieiy gngklencsfdknsandggavkiygatkisncnftenkaaelsgdggaiywnasagklencsfaknsafhggavsfeedgevtncnftd nlagdsgaiwftadgtvenstfikneawdeyggivfytsgdvrncnftdneadkqggavyfngagtvensnftnnkaqdgaiffsed stvkncifvkncatdirsdryferckyvfykngevtnssftennateggailfkgngkatdcnftnnsakfggaidfeshatvenssfn gnkassngsaiwmnraggivsssvfvnnrantgtiffrndnstshltindnifInnngvaiyfdkndsdsntdynwfgnnatnydiapv annaeintwlflnttvnpdmisildsldiafklyaytpseveyednirlkavdltltptngifnttktelgktvqyipesdgigtltas ienasytttlkitdgttffdldyiinannnntivldrdytnstfdynftdgividrpvtlignghtinaaemvrithiqadnvkikni tftnaisngygygaiywqgananlssclfennsavmagavafygstgsivsdcsfmnnsanggaimwqvsddsvvsdcsfmnnsaiqgg aiywssndgvvsdcsfvnnsavrnggaiywekimvmfpavfl |
| Contig40_gene_136_4 | 179 | mkiqrgiyliltlvlfslsaasaaddltddiisadeneelildetviddvsnandnydeelikandekfvyawk |
| Contig40_gene_136_7 | 180 | melkvdqdkclgcgvcviacpvnasispenagghgskttetimvvengfiklfsvdkcdkcgtcqmfcpteaiwle |
| Contig45_gene_8 | 181 | mnrrskliiailiviiigiavilfgsmfggekissgdkdilvcaideseseprpgmgavdmaflvhmndggitnytpiyphgmvhpsiaep eeyqamgagekllhdcfywedkqgcmqyakeileyntnyscdaviavnsqaidniisaagtlkyngeevnasgidfireeqntmgmtr gdsvmivnalmqaakdpdkrdkminaavseytagniamypegsfmellaskglqamfg |
| Contig45_gene_20 | 182 | mkrskliiailvvillglllaiagyfvggpdlsqenktilvlaadkyeqpnggcdmaylvrlengslanytpvypggmyhpssapgn lqgnmllhdclwngvedgmqyakeivafhtgveadavvvlydegvdnvldsirpieidgeptnlsatdiirendnyagykgnegvtgtm sradavmlvkavskqakdpakksamlhaaldeytkgnivmtpkgsftrllatkglesfa |
| Contig45_gene_21 | 183 | mkeykiaiiggpagmiaairaaeilgpnavcilekneslgkkllltggrcnitnntpihdqlnynknknflkhslytlipqdkllai feekdlefhqednkrvfpdsedahdildileeyleelgvdvynntpinaqdiehelnermepvfeienekislnaskiivstggitypn tgsdgdgykiashmnhtitdikpglvsfniddfilktlsgltlenvevsfkdkkkkisvkgdilishfgltgpaiidlsnrlieksdlt vlddklnlksrdeieelftnritidftpdlteedknqitkdspkngkmaiknymkkylpnnfidyflmkidinpkktmanitkkdk nklaenlkrhvfeiesLemdlakvtiggvkskeidaktleskyveglyfagevlevagptggynlqiafstgylaggeeanslkne |
| Contig45_gene_30 | 184 | maneggghlktlmiliaficglalgvsvimggdnsqtesegvhyvnvtkniteynesgnlietedgthiefssysdnvtegenvt aynsstdagnlf |
| Contig45_gene_35 | 185 | mdnkikagialalvavigfsfinesnvvnqlsplesfdysmepmttwddskkeysfnqnissangkdykditidilmyndgksl dkhtstinstkdgsfnlkftqrlegepdefyynvtkatei |
| Contig45_gene_36 | 186 | mfkvsksilvclvslflvsqasaadsnglsirdinsvdenyidasyldslqdsngmhsdsslnsngldddksnydktsisqntssn lkdndldnndgeseiiieeeakdtegvvmagdsyscgpaslatalnrlglnlslsevsqhtntskdgtnmqslidaagynfsavgveiq skdlaensivhldidgaehwtvvskvteesvfladstrgninmsidefnslfsgkailselnktnvsnviknknivldqsqclnvkg kgwrvlvgyktewryglintyswvlrpkvinghvsysawevvkkhlswgkykvkvpiykykyiknqyevkgkk |
| Contig45_gene_60 | 187 | mwydmkrrfylilfilllaaiaiigtfssfsdvsgydlgsdlsiavtgdvmfgrkmpgvldsgaspfrnvenvtksadillvnfe npatystnpvkgdvplkadpkyvhllaeaneviasqdnnhaldygdeglndsiknlkdagiyvigagnnlseaskpvviegdrkvtv lnymddnfaeyasimppatanssgfcaydselarkqvaearenessiviaymhygneysrspneyqinmshelidsgadivigshahv |

FIG. 7C-111

| | | |
|---|---|---|
| | | tqgvemyhgkpifynlgnfifdqsnpathrsyflnldlhgdnctvtlyptvivgylpqfmdadsakallaelypqcdqlkvnddgtaql tfklgnitdnstqsndvrly |
| Contig45_gene_64 | 188 | mkitvagvgyvglslavllaqkhdvtaittteskaemlnqfispiqddeierffkevregertlnlhtttdkaaaygdadlviiatptn yddvgnffdtsavedaiewtlkvnpdvlmvikstipvgytesvrekygirnlifspeflreskalydnlhpsrivgcdddqmeeggmf adlllegareeekransleqdipillthlteseaiklfantylavrvsyfneldtyaqtkgldtqmiidgvcmdprigghynrpsfgyg gyclpkdtkqllanykdvpqtmieavvhsnsvrkefianqiisrnpktvgvyrltmksnsdnfrasaiqdvmksikaegipiliyeptl ddgsefsrsevvndierfkresdiilanrldcdvlgdvaekvytrdlfrrd |
| Contig45_gene_89 | 189 | mnlmkitvagvgyvglsiaillaqkhdvtaittteskaeklnqfispirddeierffketrdgkrklnlhtttdkesayknadlviiaa ptnyddvnhffdtsavedaiewtlkvnpdvlmvikstipvgysesvrekygvkniifspeflreskalydmlhpsrivgcdddqkeda qmfvdlllegvrleekrsdspkqdipiliapfteveasklfqntylalrvsyfneldtfaqtkglntniiidcvcmdprigghynnpsf gygyclpkdtkqllanckdvpqalieaivnsnavrkefiadqiisnnpktvgiyrlimksnsdnfrasaiqdvikmikaegikiliye pilddgseflksevvndidifkresdiilanrfdqdilgdvadkvytrdifgrd |
| Contig45_gene_91 | 190 | meiryknllkvftiflvlliscgfasavsdldegnsanivdngdlslsdnmmsesadncknletieeshtfseknvtkdvsyglstpid gntfediqtaidnaadgdiielngtyfgngsdikitkdltisgnletildaknksgifyvnsnnvtlqnlkfynsivpeygsavhflsn gsvinctfinntaggvvgtidyfwstggvvylakgngsvinctfinntanadggaiycgvdggsvinctfinntakelggaiyigghd ggahysnvydcyvdncvfinntagegagiyygggglifnlyfy |
| Contig45_gene_93 | 191 | mkiryknllkvftiflvlliscgfasavsdldegnsanivdngdlslsdnmmsdsannckinletieeshtfsekstvkdvsyglstpid gntfediqiaiddaqgdgtiqlngtylgngspiifsknltigssgetildanglsgiinsssekivlkdltfvngsgftvdlrenngdn lkycsiincsfekcygdknsaviclnqsgiildcdfhytnctinimgsedvsilnssfnytggvaihsnsstivkacdfynsffetyy entnkvyngnivdlcknssisdcmfkgtyyetiidslvdsntyqfstlhvcdevdvinctfirsitefsgsaiyhfgngsiinctfinn saggshgtpsylytqdgvvyigsddclvinctfinchsntfggalyinarncyvinstfiknsayeggaiylaggdcyvinpvfsnnka nhslyndindlnavsyendtsddnqtekinpsieldyldnnlliifkdiegkaisgesvsliinnktisvitdsngeakvplnetsmv kafyvdanglnvsssmmikiveknyipikrnssfidcknmttsaitnskirdgeyfvvslkdangkplsnkpiqigfngkayddrttne ngsarlqinlayvgtytfavcflgddyyngsfvvakidvnaqkaslnapsktykastktkaltatlkdakgrlvsgksisftingksyv aktntngvatvkvslskkgtynftakldndktfkttassgklvik |
| Contig45_gene_100 | 192 | mqrslfdkvktslwmlpsffglvnglgfiylgrknsnikwtiegivyeipwliailnifnlsvaitafslgsfmvlisivrsvmvneyy qrlldeeyvvrpsvesgsshgldkqikngfnekeaspkeekvkynpydlsgidknydgrikfdkykaeikemekefneknudnvkelvek rfsqgitydrfmfiikdsedlfnsqaanaldmidlapeytetidaeirkkmetlrtiiekndelrdeliinmttetgsemeiknlfed mghltsssikhye |
| Contig45_gene_106 | 193 | mkfknshillvslisifillslsaasaadssdiaaddssvdiveledinikeshylcddastgsedlsgdentsasgtddatgndtdat ggddtgnatsvngtenvtdsngtnatngtnatnntkydgpvtnatipvstsadyqgnftfkvcnatgeplanqkisvsgyyfftfn ngssisttkvfttnsngllvianklnknlknldtlgmvynftaldvgkydltfsgndslkivvntlpitvnkvnaeikasnfkdevgtsk kytfklvnkntgtviklaslkfqiknssgyttynsttnlsgqvgynlnllagtypvrivnndsnlkastvsrnvtltkkvgvlsasnr tilynsaptaiikltdkktgkavagavlkvrvyttskkysdlafytdnkgqvsfkaalslgkhkmiistldnnytassitryvtlkktt gkisapkisatyksgklytitlknakngnamygstlnirifvtsksyykytgmtdgngkvnintsslkpgtykvsvssgdsgftakaat gqikitkiplkisptaykekynsgktfkikvtnkntnkiisgikvtvkvytsakkyktyvtvkttnkgiaylkvtqkpgtykvtvvslsna yysasavtskitvtk |

FIG. 7C-112

| | | |
|---|---|---|
| Contig45_gene_116 | 194 | mnskkiaivlgiillsfaivgsasafnlfggpttdfdnkfmsgtftgdvsrnnistndslsdwdsyedkernitynmscikggsfltd lyelqgmaapevrnfngedwkvyysqavpttdenktanessvinyyiceadvdnvtyminiiaydnesidcdgslycgffkddiqplle sitlkdakkapqiydllnmtkddfkqlqdyieqvktgnipetaeg |
| Contig45_gene_142 | 195 | msnsntdssdnasddasgseivsgineelesnnlitedlsvddvilqtsfytsyavksaksptvltfknstvvkgdklyiylkdssnhg isgekvifkfsnssytrttdsngmaaldiklnpnkyafsaiydgsdnysasrkdftltvakvntkltsssvvrgrnlytylkdknmna lsnkkisitisgktytvttdkngraslklslktgtystkinfagdktynsqslskkikiytlktvmtipstsvvrgqyiyaylkdsdgn alsgqkvvmkfdkiyfnlktdkngrvalkintrlgkipvkasfagstsysassksvtitsyvektkitvenstvkrgkyfyaylkdskd kgisnqkvkitlaninytkttdsngkvalkieenpgnytiklnfaktnsyyassksjkinvlnnatakiiakdqtvlgeysvrltdmns nplanqtveitaatvnrsvgsglpitkktvvinsdniynkatdsqfiksigevlksgykviinsnignahctdamgaysdvcifcif ggvdsgmfvdmaaswyqnllkkydnevvlgfthtqrnlatdtwlerahdddyspknftglsypqtylndydmdyvygrtatemannfik yavnglsiglnntvpcnvmeynvttgdngyatitdllpgdyavissyinktagyvadtvislievk |
| Contig45_gene_159 | 196 | mdecklvligfgavggvaraismkkeminekfgislkvvaagdsssaicqdgideellktkeetgklanypeygsdisgididlav dydvleatptnivdaepaksltlkafadgkdvvtsnkghlalfykeiieakekagvdfkfeasvggampiinlcqetlascgissikg ilngttnyilsrmttegmtyentlaesqqlgiaetdptqdvegidaackvvilansvlgidatyddvevrgisdvsleainlakeegyy vkligevsrkqlkvsprlvkknspfaidgtlnlanittladditvmgkgagsletasamltdliniiknk |
| Contig45_gene_98 | 197 | mgfldnvkkifdsgenkevkprngtgkidkvesvesksnyvnfnekdeqqnsedlindeildestsnetrnftylnnlihsgvkeiil dsdivygnedeesrhgiklnldnlvidgngytidalraseificdarniviknitlkngfshqagainnggeltiikssinnnegklag gilnlgeltldesviaknkaehtgginlnffgklsitkstlkenigignkaisnnggeltinksriinnqidtktnfvnkartvfvnkai karrdavisnggylrisdseilsneskyiilniefsriyntifkanesqyilyndnyednglssigifnckfiennakasivyndgnlc sidnalfennashknsniitnknsnltlnnlkikdngkniinddyifirnlspqieskiigeglaenikdikpqeekfdfgyldkkihdn ktgeileedirfenyemdyyeggieldmdnlvidgkghtiegakksrifiitgknikniiifkngflykdynlmnqggalktnsn csltvenckflnnfsgdgggaihskgnvdiiksiftsntvkmfgggainndgnlsirestftnnsaeryggaicnkgelsifdstltn niakvhifktsygkggaiynkgkltisnsslskntaqisggaiywkhneryepiitkqrgseamcyegeliitestlynntaeesdga iynegkmnitdcdinndsnnknt |
| Contig47_gene_7 | 198 | mmrktifgvifivfilfsistvsandaqvdmlndasdvelnqdlnaqpissncydnnqnlkaqpisdcsdelqksddlklseggstsf kqlcedlnksdgefnlthsykh |
| Contig47_gene_8 | 199 | mingnnniidssksnfnfkfsneanitindltftnfnkslfvisdsqltfnnvnftncssnlsliaimfpsnlitnnncnfysnsfanyl dgpfnkleiynsnfdgtncldsaikenrgqlvienssfenftgvhgsiinykgdyfsiknskfinsnsnftggaiivkyfpiayeegds fvyrhsndmlienctfynlsssnggaihldldsgseivetlivkssnftdchskfggaisilggylnisynfqmnsasfeggaiys swtnakiegsnftanegsqnagalyfdkgkltindckfidnkalkerertanaiyahdvaayfsnstfdnggvsvyadfasdskienvd knddiflmdnhdyivsveskgiklnltgneinvdslpshfdardwgwttsakiqgdntdcwafasissletsfakasgvlynlsqrylq klqlkyfysgdkrnsltgfsysgpgyalswygvlpvdngydgrgmiadtledrihvqdvlfidtgrddavelikwailkygavtvqr gingpygelptegddiaimshgthfisligwddnyfeleegdddplhkfawitkdlsgfstadytkfdaidnyaivpqraavayifen didyhvnyqtdltglvgfdanynysnefvskydefigavgtyfnesgidysfdvylnsekmlsqsgvsefagfrtikldeyihikagd vfkvvfksnsipfqaysrqhyiegmslasadgeswsdlaplnktvclkaytvkedkevspsrastkidcsnmtttavasadgrigeyfv vtlkdqngtviankpikigfngrvydrvtdengsaklqinlaykgtytfaigflgdenylgafevakitvnkgspklaspnksykltak tktlnaslksgngnpvsgkkitftvngktytatsnskgvatvkvslnkkgtysftvkyagddtfaavttkakltik |
| Contig47_ | 200 | mnkqnvfalilltiillsvvavsgcigkssdnsasdssgdsddssnslifhsgsdsdddndndndkcdkncndkddkddddd |

FIG. 7C-113

| | | |
|---|---|---|
| gene_13 | | |
| Contig47_gene_57 | 201 | mlnkkifiiltfililsissasasadstdetilsddsaglinldnsnnlylddnqfnlansnsdnsnfnlddsnsdnsnfyldedld<br>nkinenikntktilkennssiasfsnlshilskasagdtiilendykydsaydsqyqgievnsitidgnnhyidgnearifylasdn<br>ivlknikfingfnsqggaiyakgtnvnitdcifennlapdnggaiyvegnasiksvkfinnsagyggaayindssilediliftgnvani<br>eggavyiggssnitncifdgnladkgaaifipakespmtpsedvpfdesdlnstdmdldstdmddnstdynftdmddnstdynftdmdd<br>nstdmddypdesdedfpdggdyvfpdwegdefeydgiecinvfiltnstfinsndfyrgaifsehdnnisidgclfenmssyapaiyc<br>nvmvnilinntgfknlhangtggamafldnvyaivdncstfknissskngaifydsnswghsspvslivlnssflncssdyggaivlg<br>ggfksdssfinnsarygagavhyytdydilvydtvfynnrlnednstsfggalfidsaekaiinntrfvnnsndaiyayesrikinnsy<br>fenndeylrsiytegllnkydnkynddtlvdldydptyiiigtgelkldlinntidvttipssflaadwgwmspfknqdfsggcwcfst<br>caaiesallkstqktyslsmqnmqklsteyskygnnhiveagstivalhyalswmgvfpeeydfdmigklsrqistnetihiqdaaft<br>yprsisydidqikqtimkygtvtvsdfyavneapnfnentsafycnetdgrdathavavwgwddnypasnflvtppgdqawiiknsygee<br>nydhgyvyvsydtvfnidggvayjfentenytknyqtdiggdifvlndsdsysyknsyqsigddyisavgtcfndadedytveiyvnn<br>vlktsgsgkspfrgfhtiklenqiqvkigdnftvvmkthsvpivn |
| Contig47_gene_60 | 202 | mgvlasvaggiffeagmiatctgvglpvglalmgvtictaygsglfgmtdtgnfysnltdenladfgfsmslnliggysaaaakstl<br>rtvggksvqisiskaafasdqrgayttfhtisskytyiqkvengafsncgeyliegefgttvienirkslrvfin |
| Contig47_gene_62 | 203 | mfsvslnklkigrvficlflvfiscsincvfavddlafndtyysdlsvngdysgflsegdfnggsvvvdgeidsspiannknnssf<br>altskkdsssspsistsksknnknnkntssllkenktaapssqrvfydrdivsdedviggphenldwinlthvddslfsdnskedgakgski<br>attivasnlvkyylnasqlnvglkdsngnylsgktinftvgsasyirttnssgrcsltinlmpgvytfirflgdssyspssknvntv<br>lkmptsitasnlvkyyhnsssliatikdthgnplsnmtvtfkmgsnnynrtntngkatlalnmipgnfsvkistfthpryitssknvtv<br>tvlsmptsisasnlnmtyqdgsylnatlkdahnnplsnknltfhfnrtgtlniltnangqatynlngctgnfnikitfnttgyafssk<br>tvnvnikfwpstitangattyftdtvqlsaclkgenntplanknvkitankkitrttnsagnvyydfnenvgtynvnfsfkenyyqna<br>sktvtvtvnkmptsitasnlnityqdgssliatlkdshgnpianktvnfkmetnnynrttdangratlalnmipatfnvnitfshpsyq<br>tssksvtvtvnpisnsiiasnlvayvnesptivatlkdannnplsnknltfnrtgtlniltnangqatynlngctgnfnvkitfnttg<br>yaitsktvsvnikfwpstitangattyftdtvqlsaclkgenntplanknikitygnknitrttnsagnvyydfnenvgtynvnfsfnq<br>nyyqnasktvtvtvnkmptsitasnlnmtyqdgssliatlkdahgnpianktvnfkmetnsynrttdangratltlnmipatfnvnitf<br>shpsyqtssksvtvtvneiatnlavsnlnmiymdgshlaatltdg |
| Contig47_gene_4 | 204 | mggeiinneklklililfsilimtvnasdngiiaeyadistipndekvsinendydtnyyelpdkkldhlesndnqhlemndkk<br>lndgnsnndfnyiqelinshkdgdisifledktyigngspiiinknlniygygyknlsdldiktildgnsksnifiiinkgiqlnlyglsl<br>ingntsyedgaiynnglsidscsisnnaggavyssegseieiynslfennsgllgaldlenanaiiskstfkgnrcngdggaiy<br>nnigkltisnstfsfnkgarggviynmhgtlsiydcemflnsasqlggtvknwgsceiynstiknntadmygggglytfefkmtvndcli<br>ennyadeggglfadadsrlivinstilnnnakiggidakqayltvnnssilnnaksnggglyadkhpaeihntnikdnngngsgggvf<br>igdisakisdstlngnsgetgaifnkgkliiekstlnsneanyggaiynqknltvnkssfdsnkayeeagiynlgdfliessnftkqs<br>vshkaqvilsvngnikikdsifkqtsgadeggviftregnifidsslfilnnalsygaaidnsaimtignslfsrnkafgagaidnggd<br>ltvtnstftnnkvtnnggaidnngklymsgsvlvnntaqnyggaiisrkdtnieycqildnsapegdglydsgdyllisnnwgennpn<br>fdellnfnidedfkwiemnftnstplmqkkvsnltislngkdknnnsfklenpdkipilkssiqvvsedskikynlnivngsaststdm<br>klaktvnaildneivsldvlennesdddsedsdsndsndesdnpnnsndnsdnvtddsddsnksnnpnnhqsngnknndnknynkn<br>glryskmknsllnsidsnldndylnlkennenndsnssnnkdmnysdkktdlnnessnkeidenetklfdinyslliipialillvlfa |

FIG. 7C-114

| | | |
|---|---|---|
| | | frrknkdd |
| Contig47_gene_125 | 205 | mdkkmivsvafllllavalvsvfdesnsseskvnlivysegpkslselvneiktqdyyegydnetvawmeslqnkkfyygdgiivims atdasklpslyvtdvelfehfecnvlekrslgnveypkdvlyvknvkyigeeygnfsga |
| Contig47_gene_140 | 206 | mkisriivllmiliftagmvyavdlsefklnlsfkfssp |
| Contig47_gene_146 | 207 | mdskkilvilgltvjaiflassvsagdlistggynpdslilegadfnipdgferiedksianqtrnsgvfssilnrevygnpkgeiv isvvdfdnfdanlpilsmuickgcqkkellyypgfigsdgnstkfsyvfdnkvvsisapnedlinqvlvveda |
| Contig47_gene_160 | 208 | mkpyviligsasgigkstvaaelaktlnikhlvetdfirevvrgiigkeyapalhsssynaysslrnqenyknqaelinagfeehasfv lpavervidraikdchddiilegvhlipgfidieqftdkasvfffilssdeedhknrfvkrameirrggkqldyfkenriihdhliegaq khnvpiiksyeiestvkkmlsyinetcetiyklntvdeldkvgeiildrysgsiknisypikgfkeplirkidvseireydkfiknlnk fpekkeelkelysltdyrayricainnetiekikndldckeglfikedm |
| Contig47_gene_197 | 209 | mlisvlgviviiimvvaaayvgfsvvssltggissgtqvdelatlksncssleagfnitgtkiyamqnitlerefvnaqvelikvqnd ldsvesalasgqpasevdkriqqskedlkiaqqaynslsvk |
| Contig47_gene_208 | 210 | matrtkqticrlysfhggrflialsvfplnvscglifdirsppekkfgivflnffsk |
| Contig47_gene_253 | 211 | melsksdkylivvgiifclalavlspyiasgpdglelsaedanvgedveapvmeapfpdytyeplekigeigvlilgalitlivawgi gyalkrse |
| Contig47_gene_269 | 212 | mkvailgagcyrthaasgitnfsracevadatgkenismthstiemgaellelagvdevvvadpvfdgeftvvedfdyaeviaahkagn pedvmpairakvgelaetvpkpangaihfthpedlgmkcttddreavadadwimtwlpeggmqpaiiekfadvikdgaivtsactiptp glnqifedlgknvnvasyhpgavpemkgqvyiaegfadqaaidtlkdlgakargsaftlpanmvgpvcdmcsavtaityagllsyrdtv tqilgapagfaqmmanealtnvtklmadegidkmddalnpgallgtadsmnfgplseivptileslekrsk |
| Contig47_gene_304 | 213 | msvililflavstvaaidvdtndnlddgssnsdllsssslddssssddvssgssevsssdesldgnnlsdgnvsssdesvgadnlsdgn vsssdesvgadnlsddesssdalseelpktetvikadplnynyasvkglntinltdsaglalsnktltvkvsalnktsnlttnskgqaif klsasvgsydvfisftgdesyapsnasskitikkssktkiklsnihgyltisnyvsvtlldsagkpikssvtiqvnkakynvktdskgi akvkvankigtysvnakfsgdknyyassnskltitkmkvyikapsvkyymtnssapyltinltnvkgsplakkkvsvkigkktytikt nsqgiakfkftkkvssynckinfkatsnfygasvnskmtiqkmptslkapsvsinstnyqkvlislkdgkgkalknttvtvnvtelkkv ftlktnasgvatfsfngektfnlkikyagnknyaassvsskinvkqikvklsdvigasrvlidyvnrtkdlpsnvqnynnfytvqty laskavkninnknygdivlisvpksykssgeiydtvykkdfvkiansvvgssynyknkeyvsyiykvpfkvysisfakvlnfygnnkk lpnyslftladfakvkdnggynfylttdniagkksdlnmlkslaktlksmgynaviqigpdihnvayrygctgnnsvllacfggvdvg cieewagdlgdlnghsfvnsyqgahvlglwftkpygasvslnkkvgiawdadygfplntpakymkshnisyietgvanackllsegkm |

FIG. 7C-115

| | | |
|---|---|---|
| | | ggpqlis |
| Contig47_gene_306 | 214 | mnkklkiilyillaliliiliagislwylmldyspasadanslingtsevsvskinnglfldgpgndsaviIfypgakieytaylpllinlsa dgvdcflvempfnlaffgtnsadeiinnasynysnwyigghslggvmasryahnhfdkikgvillaaypadslengsvlsiygsndksl nkesyddakkympsnfteyvikgnhaqfasygngtgdgvatisayqqenetikdillyings |
| Contig47_gene_309 | 215 | metknliilicatvilavivlvlsafiyvnmgnethissniadtlqngdeivvklvdkdnkplvnktislnfkdengkgnavsydlltndk gevyynvnltegkyvfsadyagetfigsslnksvevkkdvktanlsstdttktaktktytdwqedyetgrydedgnpiyrsimstsgg qyepgiyecywsangpiserrig |
| Contig47_gene_348 | 216 | miiknysneptdeakvdsslydaqligendlgtvhlhgpfgneesdikiayligmhpleskahralfdtvldkgdlnysyyiyninvi geldeategrmdgqllaqefvahhiidrgydffldihsnrgsrspgtyeisnflfapgfdeesskymnvllskidelvyyapeyrtspe fitvpvqksgiptlvyetysyepieltyelseklvdavdsldfd |
| Contig47_gene_349 | 217 | mlvlafaiiflgysislgnnqtagvklndsnkiyingsypaepipdakidtsgvnsvllqgnelgsvellgpfgnsdseikiaysigmh pweskvhkalfdtvlaknsslkycyyiykinvtnyntdegrmdgqllaqefvaphiingdydlfldihsnkgtvggtyeqtnfafavg qdekseafvkkildkmpelvyyfpadqssppyitlpveqagtptvnyetfsyedinttydlidklvdvdnlefk |
| Contig47_gene_353 | 218 | melndeiifkvalitalvgmigmlafasyiepkeitineitrnnigetvsvsgvvesvklsssgsscflelndgtgkinvivfesvlve lkdagndlndfkghnikvvgsiteykssmelilansnsikles |
| Contig47_gene_356 | 219 | mknyfdikdkvavvtgassglwgiaqayasggaklalfarreerlqenvkeiedkfgtevmyavtdvgdydsitasvqkvmdaygrid ilvnaagmgnnkmvvdgsneewarhihidltgvvymckavgeimieqeygkiinigsihsrvifpgggisayssakgavmnltknlave wakynitvnaigpavfeteltvdsiemdgfmdliaaycpagrlgkpgeldglaiylasdassfctgglicvdggwtai |
| Contig47_gene_375 | 220 | mtfnnlrinikdcmvifvvftvllsilavsaapspdfmlwv |
| Contig47_gene_380 | 221 | misisaisaaddssiatddsnkiindnnnqdivleengpstnialedknykiekpqlkenspgnftdlnylinedettrhnttitldrd yiggekgiridrpliidgqghtlnasqnnrvfhitsenvtlkniiftgrsdyggaiywggdngkiincnftyntatkyggavfwgdde fegtadqtiakdgiiiinsnfisnkanvgngeawenggggggavywyanngticnsyfhnnraggggailwkgndgiicnntnftans agdsggavfwrgdngtisnncefnnniaygrtsdgisrggaifchgengkisncsfmensakpesesgkggaiyaeyntfitdcifi rnsadyyggailifrtgdvyrnifinntalngntitlkgighstitnniilnktnaiywnesdytieanwfgnnatqysepyeysqtwl flnatanpnpapfniptevkfklwlynkktkkiteydnsllptiqlslsqtkgsinketaglddpinytanevgtgsitgkmewitdsi ffeivndpklevsvnpseidygdnitlhlgyedeatgtvnisfkgsthektieniplnktititesilpdeytvtvfysgdngfsrask tadeklkingknpnmtvtsyeiyvndtngvmfsiklkdatgkiiltgdigreinltegsikdgkriieiknngfdlgkynvtfsypgd eiyweyettalseikvietkiipqkeeivlligdksinytinpsnavgdvtftsndtnvvkvngsgdieaidkgqatitikfsgskdy apsnatvnitigremakltaenittvtynaegylkvalkdsknksisgailivdlinktnyttdsngeikvptkslaagnytasiefegn dkylpanttagvtiekdnprltsnnitnkyhtedylivslkdsasgpisgaeltvylngsetyktdgngqikiptkdllpniyvanisf |

FIG. 7C-116

| | | |
|---|---|---|
| | | agnenyteanasasinitkldtrlnatdtitkynvnkdmivtlkd |
| Contig47_gene_381 | 222 | mkfkylfilllialiciisvsavaasdandpisqdnngglvleetnqdlsitktkeivesstnkeislednkvisken kktslkdeetd sftnlnlinidnpnnhtislncdyvlleedctyidteilsssnlttshilrdegslpidlnpktykarlmvensndqsievi kttnie gssfwllnqtinnnsnseitldsnytfnssadsgfingiyinrslklngngitingldegrifilitadnvtitnvnfangks dkggail wlgknqnisncnftdnmatsggaifwgntnltdyysnggddgtiincnfigneaqkggamffhtggatikdgctfhnntgq eggalf wlnyggriencnfftntakgsggaiycpqveilnncifqnntagskieerimkggaiylqkggtvrdctfignialndesdg lrfyk ggepftlkgmppfptaps |
| Contig47_gene_382 | 223 | myiseleinqniilntegnkiylnnspksnihdnwfgntllnydevpyegctnwiflngesnqvslenpisfeitftlss fnkntkkis nyddrklpfnltahaehgilnpnsnllgkttiyeteiinveriignianidsefeimeflvtdgttfydlnqlinnnsnne inisgnyt yhddidfefkeginvnrsliingngftinglnssrifningdnvtinnislingngyedtydsdggaiywkgadgtliqsn ftnnsgyn ggailwegdngrilingqhiqnkqrirmeevpsp |
| Contig47_gene_383 | 224 | micyadnlsminntmesniasddnggailwegeigriinntfknnyaseeggaisirgeigeiinntftnnnasyrggai siiitsgei inntftnnsgysgggilcygnnvsiinntmesniasydggalyvsmdyamiinntiknnasdnggaiywdrykgiislnti annnanh ggaiyyegyssnlnynilnnknseiyfdnvrtfngsnnwfgnnasnynlnptsfeydnspnvtlsdwlfingtanpkivna fessqi lfklysydgilisseydnslitdtklnlsaergrfdktsasfnepinytaleggrdtirgaidksgysinltnrrvsski amdtkeinys rnasiklnyndfagqnvtirlmgenneylfenmtlnktiflgvinrdsynvrieysgdrsfleenisesliavnkagtki vptndtidlg igenskvnytfyviddeqyitnpedignisfksdgsavevdsktgeintikegtanilirfggdenhldsnasvyvissnk irtkita enlttdykkddyiiarltdltgkpianaklivelngtnnyttnskgeikvptkgldsneyiakiiyegdesyrfsnasvrli vnklnte itannittiynitkelvirlkdvngdpvsgveltvdlngmnnyttddngaiveikglipnytakitfegngnynkastesd ieilki psilngtdmtvnykedkyltvslkdknkpihnasisvelegiknyttnsdgqikvptsslpaknhtamirfegneiyek snatakitv nkisgkltasnvtarygdnqnlvislkdssknplsgfkvsvdlngkknyttdssgqikvstkdlvpdtykaiivfagnen ytgsnasas vrinrintttfkytnmntiafdsniegrigeyfrfqlldedgkplsgkqvfigfngvkynrttnetgearlqinlkyvnh ytfaiaflgd dyykgsfnvalinvteqipvlstsaktykssaktktltatlkssr |
| Contig47_gene_391 | 225 | mdkkmtvllvalfcllcvgsyllifeparhisyhevnltdtcvakvpvtdkvssytdnlnihyssdyendlnitsfydva pesssqqhlr mdnlkkevlgteksgagnltyyknnnagtytmyvedrmshnyillsakdltiftnvysslearivvnetdidsldssya |
| Contig49_gene_3 | 226 | mdrkdliiilvlliislllalglnhhqvtdqgtdlyrtkvspsfsldvplssnltrenvsenmyivndyqndiqlisfnmk naskmdl iedgyqylkreesykfgaeeiikisnhtvwhnkddgsyiaffspnntedniomlvthdnitmarilssary |
| Contig49_gene_4 | 227 | mtseimiltptavvlaadsavtisdiktydgankllfylsnkppmgaliynladfvdipietiikefrrkidgkedlslie ikdefekyl hqiiskerstlsfqeqldyfiefigeelsyvdfdefkigelkdelsdfdiglilgdfkdevqsqidlyedkfslalpdcn gldeedfisd lkklficnmflmpfigiaisgfekdemfpsfihfkinylydeeflrdvefgsigdeevilkalaqddvintflnsidskt eraledff |

FIG. 7C-117

| | |
|---|---|
| | iefknflfnyieyciksnediseenenflleniisdmefsdekvrnifigfiecikakqkkpildsisvlpkgelsnladsligitslrr<br>kiedevetvggpidvailtkgdgfvwikchdsfdkdlnpqffdsn |
| Contig49_<br>gene_12<br>228 | mgfkrkrlfssdndnemekneeknksgeetfyeesdekafyteyddsgfildnnsddsfnngsdddlslndglkedlngsddnlslnn<br>gfeedsfgsdddltlnnqpssnrnfnylnnlihshqneinldsdivfdsqmdntyleginldmdnltidgngrtidaqkksrifnvlge<br>nirftnitfknaysnedggaisignyssvyfenchfisndagendggaisigensictikdsvfkqnkadsggaivnegtlkimssnfe<br>ynssqvfggalythhskveiaysvfkniisssgggiylfdcdmilieeslfidnasmseggamaneyggkiriheslfrnnhsliggal<br>cnkgspvddgknlvsvsdskfeynssienndtiystgvlklegntfnendrilasnnpeiinskyveatediidlaksidysiagesnl<br>felldsdirnfnylenlirssggeiildsdiilgddedytdgirlsnenlridgnysidaksrsrifsisqcnitfenlrfknayseg<br>nggaiysvnsfltfkscsfennssdnggistenstnefktlstennrnefktllfedcsfennssrsggaistenndlilktclfdrn<br>esnlgaaiicqngkvrldncgfkeniasdgaaiyyslpigtyinddsvnfleindsvfeanrltgtnltvsiidcdcsisfnslsfkd<br>nkfdygdlinqkylenknsiikskfigngggitasnlkviscefidnrsnafssqeyfydgsseiedctfknnhcaisshesslkikd<br>arfygndsaimnrgkayindsrfrdnsmaiensansymfasnlnlldnasgeshdminqqhlsvidsdfincnktlnlicqednedavl<br>diegcsfktdskrpisinggssilysrfeldqskiaifndskinidalsfkdyegndlegkliynndylksktrdildkidssesait<br>kyayetlpadwkgfdylinlikesngevkldcdilindieedyyg |
| Contig49_<br>gene_25<br>229 | mrkkilfltlmilicftlnsvcaqsldninyandgfdsdemincdlhkdssqkslksnalsnkktntntvkltdmkkaesndvkqtgaak<br>asntkstskstttknatksnttkstatktktanssstkkatqntttintqtlakssssymayveknaklqepitiskkkykspeylylvs<br>kavsnisktkveikdkliitnysntdcksvngtinkteyvqvakktvsfieknhrapnwiasskgniprnglilvfskcldqynksgklp<br>ssiklndldlnkmkqkidsskkvnststkktntsstkktnstsakktnttstkktnpttatstnnnkslvestldsiksilnnienklnpt<br>nkvlsttgtkkntvtvnsskvnvqisssstvnvkisakdntnsgkntnsgsakktnttstkkidtnstkktnttstknnts<br>sakktnttstknntssakktnttstknntssakkvntssskntssakntsttakssnskylstsvlndkylgeslkkylavgkncqv<br>tnkaiktlantltsklksdykkgekifnwvrdnigyekyrntkkgalktlqtrgqncvdhahlivalsraaglparyvnannckfssgy<br>vsghvwaqvlvgntwvvadatsnrnkfgvvknwnvnsyklvgkyssisf |
| Contig49_<br>gene_29<br>230 | miagvsasdimdasdnpnddsinlvsqesgndqisneaisvsnslsanddsyspesekisskiktsnnlsasnstktttkaaaakttk<br>tgtslqpsstsiysgqylvitilkdknskalsgqkvliniskfkntytkttdskgqvklavnpvgsfklvvsyagnqnyssskysgtlkv<br>sksdtsltvastsvtmttplvvtlknkktnealsgkkikfvmdrvsysrttdakgqaklkvnmkyvfnvtvkfdgtgnlksskvtktik<br>ptkipvsfvysansvkyghsitvslknnlnnktlsgkkivvktsdskksttkttsskgtisvpinsvgdvtvslsyagdssykaasssk<br>kikglkdsskitsstgtipvgdsytvtlkdssgkalsnkkivffdgksytkttnskgqaslaiskgpgtysvnvsyggdsyhsgskls<br>knvktsnsmisianvikaattlrahvdytnrfnksyvvtinglkyspdefaymmsqaivkinngqksgyvtfknltgdydskgssingn<br>lmkknyislantlissvnknnkipanistnlgkieanlyifglakalqfygeekylpkylilknsfikgssttvtqkakilnckeafn<br>atefekylktggksalnsaivakakslitkgltsdkakanaifkyvrdkvsysyysdskkgaaktyktksgnccdkanlivamcrsvgvy<br>aryshaqgctfssglvaghvwaqtydratqtwytadatssrnslgkinnwntkkysqaknyvlipf |

FIG. 7C-118

| | | |
|---|---|---|
| Contig49_gene_40 | 231 | mlaipagfaadiesnshnnlddsntvnfeinanskdtnlesnlntgnlemnsnntnldmnskarlamnsnasdletlgltrgefengs<br>nnpsleysnslsdnsnnkyispssdkntygsnkvgdgnvnlyyfdasasddtgngslerpyktlknnrivensinylangvynidati<br>nknnisfigadssrtiisyastafitnnilnfenitlkglniqnrgnltarntifiggkgywdrsynnifggaiytpqnenyttiiinc<br>sfinntadyggaiyacggnvtvenssfinntaerfggaiasentltnnirnvefihdvslndaggglfisftqlngtdlhfyncsadfg<br>ggitalysnvslnrfigkdnkarydggaiyqfycslliensifannsannggglyvdnsnslkvtksnftqnnatekggaiyslwntla<br>egnsisntrfnnsfsnnmaknysnfyegkdvnmrigsgnvtlyhrneteideipsyyslidlnqvtsiknqqsggncwayasiaalesa<br>iikaggealdlseesmknlivlfsdygypwltnngngdfanayltslwlgpvfeddnpgddrsylspvlnsrihvqniqylgrnnytdn<br>drikeaimkygavatsyymdnsyynyrtsayycpsatssnhavaivgwndsysksnfkttpqgdgawivknswdtnwgdngfyvsyyd<br>ilifplgsmdwghayvlndtiklldknyqydisgltdyfynasstawyktkhtadedeylaavstyfltttdytifikvngeelynqsgn<br>seygyrtiylndfdiplkagdvfetifkinvsgetgipvsegsafnkvlydrnqsfvsydginwldidiywtynsdvygshyyvsaalc<br>lksfsfineigtnltlefnysldnegdrispvniiahvineygfnldngvkfiingtetiadlingyaniswnftdienevyalfekt<br>gylssanetatlsekyvtldintllsedkltitvdssrkinetl |
| Contig49_gene_43 | 232 | mrlryfaiisllllfllvpvsfasetnldsielndladssteidddstdlnqdyssnqdlslnqnsdsnlsneqelysnklsensldsns<br>qssndlsnslylssngvrladlnssfaqfntslndsntiyvnssyigsdefgtqsnpyktvlaginaattdlnnvyiangvyninttit<br>vlksiniigeslnviinasnennilsvkgssvevsifnltfrngyankggaiyvdkssinligslfdsniayvtsdngyggaiynnagf<br>lklynttfknnkvvaaynivsegfggaiynelgemtvlnskfynnsidirnisksssygagaifnragfvtifnssisnnsiytnyslg<br>gaisiwasrnvyiinstindniiisgsygfasvisnkgtllqienstisnnninassvenstiyningnfnlinskmennkiktlntll<br>mcledqlivnssfnlanelkglnmtslpshydlreeglvtavknqssgacwafafysamesyllkvenisydfsennmkncmgdgsen<br>stdwddgayvvalayllrwsgainetddpfnarskvsptnltrvkyltdalyipirlgaldndqiktailkygaifvpvysniikans<br>ksgysdiqyicnhavaivgwddnysasnfkdtppgdgafliknswgtsggeqgyyisyydasfaasietsaavatnvvnttgeyrnn<br>yyydtfgntfetigynsdtiwfanqftaisdnplnafglytygdstytvnitvnnksvytssgkivgagfhtiklsryvpltkgdtfri<br>ivklttpstlfplavetnysgftpraksdyngsfispdgktwydlrnssnnravkfyedmyfytlknasvclkaytafadelelnlssn<br>spiyytgdtiklnltvtnrgdlasnssiavpldksysivsyksenngnksydihyngssfnmasgiwsipyleneesvslilslkmns<br>nndvnikvsansssvkdnvyanislkykipskfanipsintta |
| Contig49_gene_44 | 233 | mfiglllliipisfagdadsysaysgdsisleddsnylesntvlkdsknslqsidddclignrtlddtsysdstnsedltnpdstn<br>pdstnsedltnlessantdssseiktitkslndqntniksinydeyadyinlinqlinydfaisdsntifvnasytgstengsqaspyk<br>siysaynyafglssddtrtnvyiakgvytvtvtrrmtinknlnligedsintiidcngngaffisprrsyttvysplinifnltftngryss<br>ggaiyinestvnfvnvifknnraeasyygsveggalynnkgfvriyncifenntandtsdacggaiyndmgemtimgsqfinntakgen<br>aaggaiydfsgilvifnstisksslsnysmgglaswsshnifilnstfdsneghgkyvfgsaiankaimmyienstfsnnlangtsd<br>kngtffhlngvldfdnvnftnnrainpkedilicledqfiiseafsqediaeilsemelsqlpssydlrdynlvtsvkdqknsgscwaf<br>stlaalesyllkyentsydlsennmknligayglngtdwdggnhymslayllrwsgpvnesqpfndtshnsrtftnivkqvedvlyv<br>plrnyldidqikaailkygalyttlcsddsfdnnpdyycdvisisnhaitivgwndsyadnfavrppgdgafliknswgpsegydgy<br>wyvssydktlagygydaiaamaftsvanastyknnyqydtlgntfesigycstawianqftalnnnplaafglytygssylvnitvn<br>gisrlvqegnvkgagyhtikldvellsgdifkiivklstpdsnypvaieskrsdyssransnpqesfisfdgqnwqdlyevgdilkf<br>ymymnnktftepniclkaytigpsdvhlharanattytqgdtveikitvsnegatvndlnismkwnssffiksftklngefdstkkiwh<br>fdtfseggsstltlvftmrgnndvaslsydynysgfnpgdanttq |

FIG. 7C-119

| | | |
|---|---|---|
| Contig49_gene_81 | 234 | mgifdkvksafessknfkyldddlihsglneivlddislsknekmkysngieieidnlvidgnghaidaqgngsiflctgknivvknih fknqihsnggaienrgeltimdstfdgnnaslggavfndgpklmiakstitgniakeggaiynndgevyisesminenvssfhqysgg aiynkgeltiekstlirnhasfggaigniqqlniidstisnnessgdggaifndnaslsisnsmieanvsdgleggaiynkegelnit gsvlkqnelvgqigkggaiynggnlniagsslcnhsinffggaiyndgkiniaeskfnenssnrnggaiynegevnirkssikknks dggvieningdfkifnceffsnesqgniifngdsleinytdfkdnrsksmllndgvkskmslvkgeingndvkdtlilnegnsltiset vfennlipngdaivnsnlilitnpkinddnqeirnqgnlllkrssldikgkingegkietddhsnedkfdfgyldslihgspdkeivld kdiklenyevdfyeggieldfddlliingngktidargksriftisgknitlkhitfknghsyknydnplnnnggairinananltitdc kfldnlsedyggvliynggdlvltastmkgntaendggaifssgevkinkskfinnsgnnggaiavnsndkasvtesifnenaadsk ggaiwfhnsnialadctfndnyatcgaaiygeiskgsisnstfkrnlssyaywhdgklvtnknhaifidtgslndfnqdrdniincdf idnnnnlyaqkhdlliksrldehlalwkrnl |
| Contig49_gene_96 | 235 | mliglvicagvfyfgfnyatptylifnatevneggsftgvlndaygfpvvnktityhkpgyemgtlvdvqtddtgefvienaqylpdag ednyygaftfagdgkyqgcsfdgnitvipkk |
| Contig49_gene_128 | 236 | mvlavvvigstaflnydetvkyttynlsktcmmdipsgdnyenttvneairqindtnrdltvlfynsednstvarvefeftindfka tateqtvanrtvwyneengtymaflgnsvthdniiiiitndveilehlissvkfiflnedgtvnstsdmvnnqsinvtggtasngtdasa statsnvsssnsqstgndgyywsgqdqdyikeytdsngiqhidrrngpneaydpntqrhytdgvedtaayngdfn |
| Contig49_gene_152 | 237 | mdktlaiialivialvavgayfatsggssdnvvrighlpsdhdtalfvakekklfedqgltveltqfnnggdlmtamasgdidigyag itpvmssisqgvpvkvvsgaqiegsaivanknsgittvadlkgktvatpgeatiqnmlltsaltqagvstdsvefttmkaaqmtdalka gqvdamiiwepyssiavkngdgvlliensseiipghpcccvaredfikdhrdsldkvlkaheeatkftnenpaeaakmlpedivpdqel qakviadtvfisgldaeykqkvmdfmalevqlgllkqplteeqifadi |
| Contig49_gene_167 | 238 | mnnktlfiiglfficllftipmvsaadadsnlidnsvigtninsqaittsdasidhssnanaintninsddivsnnnnnsiidindsdi esqkdgssknikstnkntndsnnetednilvtdinlgknnknsndknilsanaltadgtgttfgdlqyiidqdttgtitldknykfes gtddayldgitinkaitingngnhtidgdhlarifnintgsasdivvlnsihfingmadgsgdnanggaiyigsptlnyitainctatg nggaiyahadgtniaanylylynntavnggalyvygndytvtvvdarynsasgnggamyaygnsfhlnkvnfinntaygedseggaiff ahnsddsivnnsyfannsanrdggaivwdggahfgelynskfynntanhssgavrwsgengtidncsfidnkaygtnlepgdfdggdq ilgnggaitwlgsvgiirnsnftdnyaeangggmfliafdindpnsicndthiincnfisndaglnggaldwdgkayngsvsgskfyn ntaarsggaifwkgnggiltqsdfkynsangthlvqpegfltpggnggaviitgsdvnitysnftnnsarargavylqinnntmvins sfennsagtnggaldfytgaengkvinstflnntanrsgggiywngekgvingsifydnkalngtyvngsqitdggdggaiiwtgshg tlenstfknnnatnrggaiflekhnledpndycknitvlnctfeknsagtnggaidwfegaengriinstftenyarrsggavfwngvn gtisnstftlnevglegadtvgetiptgdddggaikwtganglliensifrenkalegrggaiylennengtvnnctfelnsaftngga idwhegaknglinstltnntagrsggavywnghngtingtnftdnkalgthhteggteggdggaiiwtgsygtielsnfhnnsarwrg gaiflqknvhegeehcynttvknsyfeenfagsnggaidwsagam |

FIG. 7C-120

| | 239 | mfkvepassnvtveavnityldnetitvtvpitnasgtvvikingtqkdertvsgdnptynitvgglavgeynvtveysndpnynssna<br>stlfhvdkanipdvnpdtgivvvptnitynddetitvtvdvpnatgnvtiringtdveltknitedgsqsvtfnvpglvvgdynvtvey<br>tddanyndvnasalfkvepaasnvtvvptnityldnetitisvnvtnatgtvvvkingtevnttftgedkptivvtvpdlavgeynvt<br>veytddpnynnsdasalfhvdkanipdvnpdtgivvvptnitynedetitvtvdvpnatgnvtikingtdveltknitedgsqsvtfnv<br>pglvvgdynvtveytddanyndvnasalfkvepaasnvavvptnityldnetitvtvdvpnatgmvtikingtgveltknitedgsqtv<br>tfnvpglitageynvtavyhddvnyesnasalfnvkksapvnltvtatnvtygdnvtvtatvpndatgnvtitigdytekkeitpgsnt<br>veftvpdlevnnyvvyanyssdsnyesgivnapfhvdkapshvevdgidinytdletitvtvsdnnatgfvtitingtdieltkevsag<br>qavfdvkdlvvgeynvtavyhdsdrnylnstasdtfkvdsdvknmtispvnitygenetitvritdnnitgnitisvngteygpveldn<br>gvavfnvpglivgdyevtasysgdsnynpasstetftvdkekpnvhvsenidygknetitvdvdfnvtgnvtikingteiatkeind<br>kgravfvvpglqageyevvaiyngddnhessegsdtftvatvtpnmdvetedidygdnetitvtlpkdakgsvnititdengtvvyege<br>aqledgkatvdvpgitpgpynvtvkypgdrnynptnktvrfnvdkvvpdvdvdtvnidygdnetvtvtvnpvdggvtptgsvnvtvrds<br>dgkvvyegnvdlvagkatldvpdlgagdytvdvryggdsnyddst |
| Contig49_gene_168 | | |
| Contig49_gene_172 | 240 | miktdnkggitvellllsftfisilaltniisdanevnnshgcskktehskelpqtdwqsigrtplttigrtrerkaysi |
| Contig49_gene_175 | 241 | mlnrkalifslivlfmlsisavsasdntfnegtlnediadlndfsdlnsnfnnglssnavhglddsnnnlssenmisssdekgddl<br>egsdsdsikdninsnsikdqnnsnsstadksntkigtkisakdintyykekssslvlylkdnknqalsnktiklslngktyaqltdklgk<br>asfslyglkpnsydakiefygdddykksvrtvkvnvkkvdisintkdfstylnsniffsvkvlnkltkspvegirigfnvyssqknykn<br>yyalsdkdgiatlkkniklgsydvytyvkddgqkdyinyrntknkvsikisapgemgcsslyihvnenesavafrrdstyaadlyivaq<br>kwhgrnavkqykltgtyffhaivtsdgwlvgtgadnptinkkieslagqmvssmniqnsklntirkyerslgighfaivdpkgnyaiv<br>wksgyvkgklkngqyidvpnsrgmfrkgsyksfskdtataalriaatdrfgvnrrditvfhykrstknyqtsaqvkayaandkgnlagr<br>rtggksdnihykktyisrsklpgtpnkllgthsfgkidtliktgtkvsapaltangnqtkyfkvtvrnkktnktlrgvkislkvytgs<br>kfksyavttnksgvanfntkalsagtnvtisqanhkyivsgsskiviktvknntvnstnssvvngsvngsssnasvnnasepinn<br>sttdnssenngsagnssssdssvgngtasdgyvngnsssdsvngtasdgsmgnsstsdgsagngsnfasvidvsaainsdsnvgnds<br>gsnsktetklssmktdiltsfiklin |
| Contig49_gene_180 | 242 | mdnkailigivialivlivlacfayvtfngnapislnvtenitnntdtsvdttdnatlvsqdpnndsevkdiaknvsesiseqnkavadsg<br>dtlhkqtftvsenetgnegmepgtyvmyytendgpikvqkid |
| Contig49_gene_181 | 243 | mdssdlnknigtnlennfntdsnnlnsnfnsnlnsnidnstqeldlstknfkalss |
| Contig49_gene_182 | 244 | mdgsysnltnlnfytnatsensnyltpiyineasdlviennpiyidysdgcnylaqiyafgasnnlignnrisiysrslsntskhyi<br>ygidfssysnayskdnakgndissntidiisdyyanaitlscavdttlesnslhlksdsfvygmvaeyfdfgnglnpsnnfnftknti<br>eassnmvyaiqffnvfdvnikentiktnsngsygisayesynhdigynnlfvngndvsmigtnfdaigtghsgiyymrcshdlsihdnn<br>vlsnyslggdyairfdasseninvfknnlssnngkylgndavngnvtvsennhyygdndlgtndlrifdiyydlngncnkgdgsigkp<br>fksiskalsylknltniyssasssttvkgiihlgegkynygtnlriyitgldveifgsgynktliidgvsshwffdisedssvsik<br>nlslangyyryndgglihnkgnlylencifdnakmspssaiiyndgilnknlmnmtangyhiynngfidglynlfigdslsederll<br>ntdslsfiltayvhddngnpitggyirffiegkeilvnsslieglaklytfsslngilksgyysnaytnlfvnigkvnssiisdtikv<br>yvnysanesksdgsfekpfksindaldalntciepvtitvlddetteqiddsrlnrnnvitiesinktnistnwtfksdanirlkglif<br>dgylvkdntyltidnclfnntpasaivstngsltlnsnftnnnvkdnhtfytgfstpvittslwdiqydykgavdnsfsnlltln<br>cnfafneayngaifnngsdlhisnssftsnlafsgfyenpraidfsnamdkdqdrnvaskggaifqylgeevvtdtgflnntaggyg |

FIG. 7C-121

| | | |
|---|---|---|
| | | gafyssgiypyrndsssiiegipfivyetedglmdnfgnyadnllspqdiyfincnfdsnvapirggavycinnsqtqyiscnfgnnlv<br>ytynmsqlfgglnknshrkwifedeldqvysifftavnnggaihd |
| Contig49_<br>gene_183 | 245 | msyfnkghiwnilliclligtlammgsasassanlddfsnlacdxxxxxxxxxxxxxxxxxxxxxxxxxxxxxxnsyndlsvgfesdans<br>yndfstyfesdsnsydisdslvnsnsdrlvnsngliefnisapndiqlndkapiknslkeydervfyvsldgndfnnglsqensfksln<br>kalenlhdankttiyvfegtflsensydlffegvgnsqmisiigsgvnktildgeglhrlfnvdnsinltlrdltfvngfdfssggaiy<br>nkgnltlvntcfynnnvysedayqhvsllsggaienegfltienssfiknsvgsvfnqyayggaicnhgnltinnsifnnnsletyidl<br>nensyfrkwnalqtggaiasfsdgalisntefsnhsisilnkypfvqktfmtfsaggavyiegnnhnfincsflsndadngavyfkgn<br>ntcfdycdfdnnsafmgaimtidynlneawmptlknltsnkysnlnisnsnnhfictdfgigyrispggaagyfkidnitidnss<br>ftnngvlenctifvssrcggavflygqdskvnnssfvhnnvevggaimnygfdtnvsnskfinnsacysdggaifhsigdllidncdfd<br>ynravknggsiqasydytnnylfeqkslynnsrfknsaaeyggaifdmgnavlyndlefinnsasyggaiynqfsntfrnstfvnnsa<br>fsedysnggaiynygsnalyessifinnsadmeggaisnfgescvvqnntfnlnkafkggsvylsgqgrfqdnnvfssfaiygglyn<br>sninliclsnsfnncsanvsggaiynlvstlelysnsmndckakslsglsgnyvftcanisylvisfanngsfnivdnkgvllvanisd<br>nmgnpitgnftfilfnqtnqdidligsgsssssnspsnlessiigvcdvveggaflrydtylelgsrytisgtysyaaepvltqva<br>nlnsvlstrmyfssnitddmvnfgegfnyeiillldsndnyipnae |
| Contig49_<br>gene_184 | 246 | mknkamflisalliavilslsavsaaddaiaadididdsievssvdlsadtedisytdvsfntskdkntlssniveegdgswyvdskv<br>ettgdgsgqsspyktikeafdasggngtiylasgvynttndrsfslaldsgnnlsiigagsdetlidllslsnnfinvrngnnfylsnvk<br>lirsgttaisganitiedsvfansyyyggapilslgggdntirncvfvnnsagswygsgvailngnanvlfdnclfknntnnggsvfy<br>ttssnikltlnncnvtecpvafyasyfgnvvfnnsyfynndvtrlnnrycavfystdpgnltidyckfenntgvdsasilsayssnrpl<br>nltvtnsefidnkmgknsygyytvfnniymgswggnlylknttgsfgnlsfvsissaninseinlivldnttydinaieinvigtltdd<br>mgnpinmsgfdlyfndtlvgsqltfdsgvnnytfkealsgsylvkyvynstanftnfnqktsvmnisplenidvyvatdgsdetgdgte<br>anpyatvekaldvastalnanvyikagtykyyryraidtangilnligydgdvtidmnnetafcnvsnrsnvfisnvdfvngysqylvd<br>nygiinsfgnlilseckfsdnngyyyiisggstidsctfennkfqqqnsarilfnpayvnnvtfynitaigfsanslnqkydltienck<br>fydnarilisngnvtirssefanlsnqraletqgvvvlsiddctfkdsdqsviylydyasttianisnskfinithenpvyvngqeiy<br>lennevsdlaapyvyirsgyvaspitilvlnnetieqesygatlkakvlddsenaislnsfvfdfndeqingklvydemvaksmgiydg<br>tylvsasstnllnpilktgvlliitplmnkelyvstggsdetgdgtevnpyatlkkamdeavafnntihvaegvyaidtaleidtntaiv<br>nivgsgentvfdmnneinfintisansiielkdltlanakspana |
| Contig49_<br>gene_194 | 247 | mkfnksliaifvililivafssisviaaedaeddnpyhngavmneqepgsgedddnpyhhgalmnppqepgs<br>tddsqaagssqadssnkvalskyptgnplvvllmslsiiglgtlrvrk |

FIG. 7C-122

| | | |
|---|---|---|
| Contig49_gene_208 | 248 | mdkkiiigavvallvliivgaavlmggttergpgeivvaayshggepeagfdpiagwnyyaepliqstllkmtpngtyakdlatdyeis ddyktytvdlrkdvkftdgsdltaedvaftynaakesgasldlsaldkaeagdyvkvkftlnksdstfldkmayigivpsdsynnesyg enpigsgpykfvqwdkgqqvileknpdyygkqpeiekitilfaqneafnlakngeadivavpleygkekldgytmylqdtidvrgvsl psvpdtgelspddnytignnvtcdiairkalnyginrtalaegalnglgypsydgiahqlpwankeaaiedgdvayanktleeagwvds dgdgireknqtkasfkiyysasaperqalavgaaeqakqfgieiepvgaewdeiypnefsggvlwgystdpsdmygeyyssdfnpar vnnsavdkhmddafaesredsykdwsavswdgstgispkgdanwlwlgeikygyfvndrvdisndtallqphggdlfsnvydwtmtnat aek |
| Contig49_gene_226 | 249 | megdnmvniktvalaviaiivvllaifavsnvvilaqddteggipgvdmaalwslnggfqwiypgssfdpegrtlhniymlddpygevk timqytynvdphilviindqaaahifgdnildtirqhdwveghsrgdavgmsitsvnplpiipdilmgnikimfi |
| Contig49_gene_239 | 250 | mnkskktmimlimailvllltmasvsaselediqvtasngtsdaviaseansaypdnaiitsekengdeniatdngkigyenddktiia tngngnigyedddntlitsdkelnaldkgkygslsvgdyhsfeelqtilnqadggetielnydyslgaggstlkitkgltingnnht1 ygvgldrilyissIntqpiilndiiifkdggkkdsytnletnwggaiynpteggaigepadfiinnctfenngavnggaifwngsl kiidsrffnneielgsggavyangnltaigcsfsnnrvrhgligmdmltttftdegywakviqyysfysvdvipptggaifcngtckin dssfdnngageanemgtggaihsmnditvcnstftnnkaydghggailcnrsgfiynstfrnnvanvggaiscfyyinaegstfsnng geigttwmdehsfdflidnfigsipiigdiygalqnfldligvesvdvltgqyfsvggalytgldcnvdkctfernhaaegggaiyser kvtaknsafssnkvfrgdsavselmssgknrdggaiahaenattirnsefsgnsapskggavycahhlemsdssflyntayqnggalya dtigtisntkfsgnsvtkgsgdggavyilagsdarfescefsantaesdggaiyiansnsllrlnkctfigniahldggafncrgktei knsvfkrnsvdgdqgtensqggaafskgdmsisdssfeqnmakhhggaaytdgkmtvknsnftvnsanngaiyasvmndevtnsifkk ntgngdggaiyindkswpkfdscvfsdnkcvvkssvensqggaiyvrnddselkvtnsnftgnaaqgggaifsgkvneitnsvfkng asksggavyiepncnpkirgsvfeenvggdkggavylnskyslyeltgcnftkntakeggvyaqmsakvssnrfisnkatdgkgggi yvrnyhitetvkrytfefvdctftsntctdngglcmdstysvlk |
| Contig49_gene_240 | 251 | mttafdfkiegrigkyfyfglldeygnpvagknvsigfsgriynrtsnetgwaklqinlkysgyytfavnfggddeyaafdvaainv tiqtpklttssktykasaktkkltatfksykgtpipskkittftingkkytaktnkkgvatvkvslskkgtykftasfagdrtykkvtks akltik |
| Contig49_gene_246 | 252 | mnnttkiligvlmgllivgaavmfvsataindvsdgnsfmgqvqntanhvknvasndiksgsniiggsefnsqegngyfyqinytdgn frqydtktgkligsgfnedqsilgnddgfnle |
| Contig49_gene_248 | 253 | mgsknfqyldelihssaneiildsdivldfdeeseyddgiklddvddltidgnghvidakdglcrlknhaknitfknlcfknfskfpis nqsgdlifencrfihnggtiynyfgniwlknccfyrnylsrsssgysvciynakdskafvsdshfyqnevnphyglilndglievkns ifhenkgedceicvifnrkgellvdnckfkdnknvycsydfaelivsilneagkvslsnstfenenrilgsiknmgicriidckfkdsl iynsqwyssvsrpdeldfgpylevedssfankydegviansglckiascnidgrsylnnddvlfidekdfnllkdniinsgeivfdydr dvpiyesfkghgksngtnsnleddldndksddgypplgalfr |
| Contig55_gene_2 | 254 | metenliivillvliamagifcaflytfgtgndiapvepnltanqtnvtnvtmtndtanattvdaplnngayssidsssnglsgsns ynggsntynggsntnnggsntnnggsssdsgnggsvapdsgnggsdsgnggsvapdsgggsvapdsggggsssgggsepaasgessn |
| Contig55_gene_3 | 255 | mfivillafiviggsysvsfaivsnggnnslswdnitiagpsgnvsddgnnsddgllgifnsgdssdsssnsntgssssqsssspar sssssssssssssssssqsssssssssssssssssssssssssqsssssssssssssssssssssssydsgssggsvvesgghyydvnsgdeldw |

FIG. 7C-123

| | | |
|---|---|---|
| Contig55_gene_7 | 256 | mallilamscvsasnasdnlddltisdsnsldlvstsnsdilssdsgvssddssndasgdvlgsdvssnesnnqsqstldsnnqsqsgl dsdnstlldsqsnnqsnsessdssdssetviknatsisvssktvvrgnslnitlkdnastllsnktvtftfngktynkttnakgiaslt ltatpkkylvkiafvgdelyeassksvnvtlsktptsisnsgksivrgklyklytlkdakgkalsgkkisisfngkkytkttnsngvnl tinvnvgktykmtykfagdsnylsssgsvsikvkmgtsiigsgssivkgksytvtlknangavlsnqkiaftlsgktynrttnakggas lkiglssgktynltykyagnsyyggssgkvslfvktpttmknsgktivsgetykvtlkdadgkslankkvsitfnnktyakttnsngqa sltikgtfgrsyplsykfagdskygpssgslclrvkkatslkgsassivqgksytvtlkdsnstplanqtivftldtkkynrttnakgq aslkiglaagktynlaykysgtsyyngssgsvklkvkfptsltnsgksvmngtgynivlkdsksnlvsnktisigfngktydeitdang tvtllidanvpktykmtykfagdsdygassgtvnltvkfknaftisqiisassslksyvlknkkvpatvsvngvslnltsftylmakat isinsnktsgsillvpvdsnytnngsrinanlykanyidlakkvissaeanklvpnsvstniglvshdlysfglakalvffnsdhylpn ylilssddvgekhstvipsnargnasqfkaglneaetltaagiakylvasghdatnseikalaaklvsgktslwdkanaiftfardnit ysyyadskkgaagtlssksgnccdhsnlivslcraanitarfshaqgctfssglvaghvwagiyidgvwytadatsrrnslgnivnwnt nhyntlkqydhlsf |
| Contig55_gene_13 | 257 | mnnkyflgiiiiiavlavifafsldyqtnylngssngsvntnenssfnqsnngigtnvqltisaeqsfpmekiaeeikthpayegyde dtlkwletfngsimftskdyfvvmdkndaenlptsfvndafiyddftcdiiekrslgkdlkdliyvknvkfenqrivpmif |
| Contig55_gene_23 | 258 | mlndkseliksisilflliivlitsfnsvyansdnfdsaksssdlifsdsnnvyienidcsdsilinvysnkkdsnlgsyfvgsssdsyl kdsnsdsafvvsnsedsyledsnlnhsknylssqslsassksvkvilttsnlsasyktknftakltdlnknpiagaklsfvilsktyyrt tdkdglaslminlapgkynistkfegdsnyssavvknsitiskkklsisssdlskkygdsnsfqvkitdngnpisdikvalklsaktyy rtsdknglvslpinlligkyiinssvydnkfyysntnsnniivssqnpynlsvlkwgtkgniknsvlmnnipkssltnaiisacnngt pliqfgngsgkkvfinagvhghelssqaaafklinniynskkkingtvyivpvlcpkmteqnaryfmnvnlnsvankngtvsnklvnla lslkvdvlgdfhctrpngdpgknvamgtsspmassatlakyiskttgysslliykkageeypgavedvcnlkgitsvtcealtphgkias gsvgksynmmiallkyygiti |
| Contig55_gene_40 | 259 | mkkiilgtcilflliisvayagtvdiftapsplqplgnsfgdgghniqifeftenlyktwfendtdyvvekyegnnglylyaddendc gileivekdgkkyixkfpwds |
| Contig55_gene_45 | 260 | mkinlkrvilgillilicissasiisaysidsmeiqgqcistgsgledktyatiyvgeeytgadvliqiyysrdgsqlnpgnkvpktvd slgcievpsanafkyypdlaeinlydsdgylidsrdvslsihsgeqtfgdfygssssssyssssssgsssssgdgsttyhsgtsnsy vgnsntgkfhapgcdsvdkmkpsnkvyfssrdeaisrgyspcgrcsp |

FIG. 8A-124

ORFs encoding the biosynthesis of exopolysaccharides identified from *M. ruminantium*: annotation.

| ORF | ORF Annotation |
|---|---|
| Contig40_gene_55 | glycosyl transferase GT2 family |
| Contig40_gene_106 | glycosyl transferase GT2 family |
| Contig40_gene_223 | glycosyl transferase GT4 family |
| Contig40_gene_233 | NAD dependent epimerase/dehydratase |
| Contig40_gene_257 | NAD dependent epimerase/dehydratase |
| Contig40_gene_303 | glycosyl transferase GT2 family |
| Contig40_gene_304 | NAD dependent epimerase/dehydratase |
| Contig40_gene_305 | hypothetical protein |
| Contig40_gene_306 | UDP-glucose pyrophosphorylase GalU |
| Contig40_gene_315 | UDP-glucose 4-epimerase GalE |
| Contig40_gene_366 | polysaccharide biosynthesis protein |
| Contig40_gene_367 | polysaccharide biosynthesis protein |
| Contig40_gene_368 | polysaccharide biosynthesis protein |
| Contig40_gene_369 | glycosyl transferase GT2 family |
| Contig40_gene_370 | nucleotidyl transferase |
| Contig40_gene_371 | glycosyl transferase |
| Contig40_gene_372 | glycosyl transferase |
| Contig40_gene_373 | UDP-galactopyranose mutase Glf |
| Contig40_gene_391 | glycosyl transferase GT2 family |
| Contig40_gene_450 | glycosyl transferase GT4 family |
| Contig40_gene_470 | UDP-N-acetylglucosamine 2-epimerase WecB |
| Contig40_gene_653 | CMP-N-acetylneuraminic acid synthetase NeuA |
| Contig40_gene_654 | hypothetical protein |
| Contig40_gene_655 | N-acetyl neuramic acid synthetase NeuB |
| Contig40_gene_656 | hypothetical protein |
| Contig40_gene_657 | polysaccharide biosynthesis protein |
| Contig40_gene_660 | glycosyl transferase GT4 family |
| Contig40_gene_908 | glycosyl transferase GT4 family |
| Contig40_gene_920 | polysaccharide biosynthesis protein |
| Contig40_gene_960 | glycosyl transferase GT2 family |
| Contig40_gene_967 | glycosyl transferase GT2 family/CDP- glycerol:poly(glycerophosphate) glycerophosphotransferase |
| Contig40_gene_969 | glycosyl transferase GT2 family/CDP- glycerol:poly(glycerophosphate) glycerophosphotransferase |
| Contig40_gene_970 | glycosyl transferase GT2 family |
| Contig40_gene_977 | nucleotidyl transferase |
| Contig40_gene_978 | CDP-glycerol:poly(glycerophosphate) glycerophosphotransferase |
| Contig40_gene_1113 | glycosyl transferase, GT4 family |
| Contig40_gene_1115 | glycosyl transferase, GT2 family |
| Contig40_gene_1120 | UDP-N-acetyl-D-mannosaminuronate dehydrogenase WecC |
| Contig40_gene_1121 | dTDP-4-dehydrorhamnose reductase RfbD |
| Contig40_gene_1122 | glucose-1-phosphate thymidylyltransferase RfbA |
| Contig40_gene_1123 | dTDP-4-dehydrorhamnose 3,5- epimerase RfbC |
| Contig40_gene_1124 | dTDP-glucose 4,6-dehydratase RfbB |
| Contig40_gene_1125 | glycosyl transferase GT2 family |
| Contig40_gene_1126 | glycosyl transferase GT2 family |
| Contig40_gene_1127 | exopolysaccharide biosynthesis polyprenyl |

FIG. 8A-125

|  | glycosylphotransferase |
|---|---|
| Contig45_gene_62 | glycosyl transferase GT2 family |
| Contig45_gene_64 | UDP-glucose/GDP-mannose dehydrogenase |
| Contig45_gene_71 | glycosyltransferase GT2 family |
| Contig45_gene_72 | hypothetical protein |
| Contig45_gene_73 | dTDP-glucose 4,6-dehydratase RfbB |
| Contig45_gene_74 | dTDP-4-dehydrorhamnose 3,5-epimerase RfbC |
| Contig45_gene_75 | glucose-1-phosphate thymidylyltransferase RfbA |
| Contig45_gene_76 | conserved hypothetical protein |
| Contig45_gene_77 | glycosyltransferase GT2 family |
| Contig45_gene_78 | conserved hypothetical protein |
| Contig45_gene_79 | glycosyltransferase GT2 family |
| Contig45_gene_80 | acetyltransferase |
| Contig45_gene_81 | glycosyltransferase |
| Contig45_gene_82 | glycosyltransferase GT2 family |
| Contig45_gene_83 | polysaccharide/polyol phosphate ABC transporter permease protein |
| Contig45_gene_84 | hypothetical protein |
| Contig45_gene_85 | polysaccharide/polyol phosphate ABC transporter ATP-binding protein |
| Contig45_gene_86 | glycosyltransferase GT2 family |
| Contig45_gene_87 | hypothetical protein |
| Contig45_gene_88 | glycosyl transferase GT2 family |
| Contig45_gene_89 | UDP-glucose/GDP-mannose dehydrogenase |
| Contig45_gene_94 | glycosyltransferase GT2 family/CDP-glycerol:poly(glycerophosphate) glycerophosphotransferase |
| Contig45_gene_95 | CDP-glycerol:poly(glycerophosphate) glycerophosphotransferase |
| Contig47_gene_70 | glycosyl transferase GT2 family |
| Contig47_gene_408 | oligosaccharyl transferase STT3 subunit |
| Contig49_gene_169 | glycosyl transferase GT4 family |

FIG. 8B-126

**ORFs encoding the biosynthesis of exopolysaccharides identified from *M. ruminantium*: nucleotide sequences**

| ORF | SEQ ID No. | Nucleotide sequence |
|---|---|---|
| Contig40_gene_55 | 932 | atgtcaaatgaaatttcacaaaacacagaaggaatattttagtggttcctgcatataatgaggagcgaaccgtatcccaaatcatagaatgcat<br>tgcagagaggggatacaatgtagttctagtcaatgacggctctgcagacagtaccctcgaattggcaacagaatccaaaagaaagtatcctgata<br>agatatttgttgtctcccatgtaatcaacagaggcttgggagctgccttaaagactggaatgatggttgcacttaataagggagccaaatacata<br>ataacctttgatgcagacggccagcatgaaatcagcgatattccaaatgtctgcaagcctttgcaggatggagaggctgatgcagtaatcggttc<br>aaggccttttgaggacatgcccttgtctaaaagctttgcaaaccttgttatgaatgcccttacattcatattctatggaaggaatgttaaggatt<br>cccaatcaggattgagagcctttacagctgaagctgcagagaagatcgatgtggtttcaacaggatatggagtctcatctgaattcattaaggaa<br>atcagtgataagaatctcagattggctgaagtaacaatcacaacaatttacactccagagactcaacataaaggtacagatgcaattgttggctt<br>aaagatattaggtaaaatggtgattgacttatttagaatctag |
| Contig40_gene_106 | 933 | ttgttaagaggtagaaacatgggaatgaagaatctaattttatccaagagcgatcaattcaatcattacaaagataaggcaaatcaattgaaaaa<br>ggaaaataaggaattaaagctaaaaatgaggaattggagtttaaaaacaatgagcttagtcctgaacttgaagagggaattagcctaatcattc<br>ctagctataagggagaaaatcatattcagcctctttagagtccttggaaaagcaaacaatttcaaaagaccttttgaagtaatcttcatcgtc<br>aatggagaaatggattccacaatagacatattaactgattttgcaaaatcaaatcctgacatgaacataataattagctatacaagcgaagggg<br>agtgtccaatgcaagaaacattggaattcggattgcaaaaagggaatatataggatttcttgatgatgacgacttcatcagcgataattatctaa<br>aagccctttatgaccatatagctccaaatagggttgtgctctctaatttcatcgacatcgatgaggaaactggagaagagatagggtctcgcctt<br>gtcccatattccatgaacagggaaggcatattcaatgatgttgttgtaaaactgactaacctttccatcataacaactgcaaagataattccagc<br>attagccgttaagggaactgacttcaatccaaatctcaacaatggagttgacgtttcctattatgcaaggctatatccaaagaatcattttgaat<br>tttattttgtaagcaaggaagaaggagctgtctattatagaataaggcgaagcggttccatttcaagacaggaaacttcctatcaattcaatgta<br>ctggaccgattgaaggtcatcgatgacattaatgaaagctataaacaagttgataaaagcgatgaactctatgtccacttcctaaagatactctt<br>tgatgctcaaacatacttcattggattgtatttggatgaatatcctcaagatcgtgaaaaggtcattgaagaag |
| Contig40_gene_223 | 934 | atgaaaatattggtagtgcaggaatcagactggcttaagagaaaccctcatcagcagcaccatctaatggatcgcatggtgctacgtggacatga<br>agtaaaagttatcgattatccaatcgattggcctaaagaagactcaaaaggacttatctttcatagggaagtccacgaaaatgtctctaaggtaa<br>agccagaggcagacatagaggttatacgtccttccttcataaaggagccagggcttaactatgcctccctatacttcacacataaaaaggaaatc<br>aaaaagcagatagatgagttcaagccagatatcatcatgagcctagggcttctaaatgcatacacaggttcaaagcttgctaagcagcatggcat<br>tccattcgtatactaccttattgatgtgctatatgcacttattccagagaaggcatttcagtcattcggcaagaaggtaaacatgaaagcgatag<br>agaactcagaccttgtaatcactatcaatcaaaagcttaaagaactggcaatggaactaggttcaaaaccagaaactaccattttgattgatgct<br>ggaattgatttaaatgactttgaccctcagcttgatgattccaacataagaaatatgtataatataagtgaagatgacacagtcctattctttat<br>gggttggatctatgaatttgcaggaatgaaggagcttgcaatggagcttggaaagaataaggaaaaatatcctcatatgaagattctaattgtag<br>gggacggcgatgcctatgataggatggtggagataaaggaggagtatgatcttggtgaccaattgattctcactggaaagcagccttatgagagg<br>atacctgaattttagcctctgcagatttctgtcttcttccggcttatattgatgaggaaatcatgcaggatatcgttccaatcaagctttatga<br>gtatttagctatggaaaaggttgttatagcaagtgagcttccgggcatttccaaggagtttggatatggaaatg |

FIG. 8B-127

| | | |
|---|---|---|
| Contig40_gene_233 | 935 | atgtccaatatataacgaatatcaagataaaactatttagtaactgtgtgagcaggctgtgtaggcagcaacttaactagaaaattagcagct tggtgcagagaaagtgatcattttagatataatatgtcctctgcatatgaaggttgaatggtgccaaccaacgaaaacgttgagcttattcaagggaca tccttgatgatgaggagttgaggagctgtatttaagatgaaagcgactatgttgtattccattggcagctcagctgcttcgctaatcaaacagtggac aatccggaaaccgacttgatggttaacggcatagtggttaacggcattctaaaggtgcttcaatatgcacagtcactggttgttgaaagatttgtatactcatc ctctggctgtggagtatatgggcttgactctcaagatgcctttcctaactatatgacatgccatgctgtctattgtaaatgcaagttctttaatgcaagttactagc ttcttggtgaatttatatacaagaaaatgtaattcctaatttctcttcctattgtcctaccgcaaaacaggcattgcctattacaggagacgaaccgaaacaaggga ccaggaaaatacaagaaaatgtaatcgatttccttctattgtcctacccaaacaggcattgcctattacaggagacgaaccgaaacaaggga ctggacctttgttggagatatcgtcaacggcctttttgtcaatgggagttgaagaggaagcgataggtgaagcgtaactaaacctaggttcaggtaagg atcacagagtaatgacatgcaaacaaggtcaaccaactcactggagtctcttggttataagcctaccgtatcctttgatgtgttagaaagagttacggttg accaagcttttatcttcaattgataaggcaaaggacattcttggttataagcctaccgtatcctttgatgtgttagaaagagttacggttg gtttacagacaactggaagacattgaaagagatgctgaattttaa |
| Contig40_gene_257 | 936 | atgaaggataaaaacgttgtagtaacaggaggcttgattttataggatccacattgtagatgtctttatagatgacaataaagtcacaataat cgacaatctcatcaagcggtaagatgaaaacctaaaacatccgaatcacgagaacttgacaatcatcaaagaggacttgatgacgcagcttag aaaagatattaaaggataagagactatgtcttccacctgcagcacttccaggaacgttccagaagcgtagcagagctcttaagatacaatcaaaac aatattgacgctagctaaagctatttatagcctgcaaaaactccttcctgtccaatatccaaaaagtgatcttctcatctccctgcagtctagtgggaaa tccaaacatgcctcttaaagagagcgaaaactctccttccgtgccacaagcaaaagcaagatgaaaactcacttatgctgaactatatttaaagtcattcc atgatccttacgcattggattgtagcattaagtatttaaagtatttcaatgcctatccacagttcaagctgatggtgacggcgacaagcagcatttaagaaatagctaa aattcatatctgcaatctctcagcagacattgataaataccttgataacgaatcacaaacagcatttaagaaatagctaagaaatagctaa agcaaatatcctctagaatcgaatctctcagcagacattgataaataccttgataacgaatcacaaacagcatttagaaaatacagcatttagaaatagctaa gcgagttctagaagatgctgaaatcagttgtgatgtaaaatacctgcaagaacattaagcattccttgcagacattaagcatctcctgacagagaagag attagtttcaagccagcagatgctgaggacaagttgaggaacaattgaaggaggaagcttagaagacttcaaagtatgtggatatgttat tattgttaatgatgcagtgctgatgcagctggtgctgtagaggatgctgatagacctgtattgaagccggtgcagagctaaatcaatccgactaattttagaaaggaag aggcattaaaatcagttgtgagctattactagtggctcaataccatgttgaccttgtaatgcagagacactcctgctatagagagt attcttaagctaacattgagcatggcactactcgcaggaatgcagattttgtatgtcatggagacactcctgctatagagagt tgaacaaaggtgcagaatatgagaactgcgtaccactgttttacagactccaaagtgcttttagagcttcctccccaagcta ggaattgctttaatgtttgcatcatcgaatatgccttgagactatgtgaagaggcggctaagaggcgttaaaaatagtgaagtcct ataactgttcgatatgttgatgctactaaagatccgaagtgttgcggctaagaggcgttaaaaatagtgaagtcct gactttaaaaatag |
| Contig40_gene_303 | 937 | atgcaagcatagtgctattatacctgcatacacagttgatttgctgatgatagcaaagacttcaaagtatgtggatatgtat tattgttaatgatgcagtgctgatgcagctggtgctgtagaggatgctgatagacctgtattgaagccggtgcagagctaaatcaatccgactaattttagaaaggaag aggcattaaaatcagttgtgagctattactagtggctcaataccatgttgaccttgtaatgcagagacactcctgctatagagagt attcttaagctaacattgagcatggcactactcgcaggaatgcagattttgtatgtcatggagacactcctgctatagagagt tgaacaaaggtgcagaatatgagaactgcgtaccactgttttacagactccaaagtgcttttagagcttcctccccaagcta ggaattgctttaatgtttgcatcatcgaatatgccttgagactatgtgaagaggcggctaagaggcgttaaaaatagtgaagtcct ataactgttcgatatgttgatgctactaaagatccgaagtgttgcggctaagaggcgttaaaaatagtgaagtcct |
| Contig40_gene_304 | 938 | atgaaactcaaagtggcggaagtggatttataggaacaaaccttgtaaatgaacttagatctagagagacatgaagtattgtc tgttgaccttcgatgacatcatgaggacttgatgatattctcagacttcttacagtgatattatgtaaggggagacattgtaactatcgtcaatgg aacgcatcttcgatgacatgtaatcggttgactatgttactgttacaattcgcagcagaataacgcagcggaacgttgaagatttcaatctctcgcaactttatgg tgggaaaccaatgtaatcgtaatcgttaaagatgtaatgaatgtaatgaagccaataagaacaggccaataaaagacacttatcaaatgaatgacacttatcaaatgaatgacacttatcaaatgacttaccttctgaagatggctg tgactatgaagaataatgagtgagatgaatctcgaaactttgaaagtgaactgttgaaactgttaaggttcgtcctgttaaggtcctgttacgcttactct gagagcttatgtgcatgaactgcatgaactttgaaactgcaaccatgtttgatgactgcaacactgttaaggttcgtcctgttaaggtcctgttacgcttactct cttaaaggatcaaggattcatttcaatcttttattttataaggacacttcatgagttgcttattcagtcagttcattcagttcattatgattattgt |

FIG. 8B-128

| | |
|---|---|
| | ggaagacactgcaaatacctttgcaaatattgtagataatttcattccaggtgaagtctataatgttgaagcaaacaggaatgggaaatgacca<br>ttgaagagtattctgaccttgtgcttgtgcttgaagctgtaggtatagattcctagtgacctacactcctgctgaagacttactacaaaagttaag<br>accattgacttttctaaggctattcgtgattcaaacacgatcctaaagtctctctaagaaggaattaaaagaacagtcgaatgatgaaatg<br>gtattacagaattgaagattag. |
| Contig40_<br>gene_305 | 939 |
| | atgactaataaaagtcctgaagagagatagaagaattaaaggctcagctttctaaatatagaaaggaaaaccgtattcttaaagagagatgtgc<br>ctcctatgaagtaggattgaacatttgctatagagcgaaaagagctgtctagagcccatccatcgaatcattgaattggagcttcgac<br>aatatgattggaggagctgattcaaaacaccgcaagttaaatcatagaatcgatattcttcaaacagagcgagaggacaat<br>gagaaattaaatgaattgattaataagctaacaaaggaattggatgatgcaaattatgaaatatctcgattgactactgaattcataagcttag<br>ggttcgcaaaaatcaaagaacctattttttagaaatcgtttggatattgcatatacaaattgctcaattgaaatacacctttaaatgaatttg<br>aggaacttgattctgggataggcttagaggcaaaaacctgaaagttatgatgatattgacattga |
| Contig40_<br>gene_306 | 940 |
| | atgaaagcagtcattcctgcagcaggcttggaacaagattcctcctgctactaaagctcaaccaaaagagatgttgccgtttatgacaagcc<br>gaccattcaatatgtaatagaagagtctgtaaattccgtgtagatgatattctaatcgtaactggtaaggtaaaagatcaattgaagaccatt<br>ttgacaggtccttcgaattgaacaccattgaaaccaaaggaaatttcctaaaagaaattgaatatattcagatttggcagatatt<br>catttttataagacagaaaaagcaaaagtcttggagatgctatatattgtcgagatgcatgtcggcaatgatcctctttgttgtcatgttagg<br>ggataccattacaaaggatacagttccgtgcacaaagcaattgatgacatctatgaagagatcaattgatgataagtatgataagtatgaaagctcctt<br>cggatgaaaaggttgaaagattcgtataaatagcggtgaagatagcggttcattgaagagattcaatctataagttgataagtgttgagcctgatacggtgg<br>agagtagcaccaagtaattgactgatgccttaagcaagcttgaagatgacagtgcaagatgatattgagattcctacacctgatatcaagaagcaagatgatattgaattcattaaagaagagattattaa<br>ggctaaagacttcctaaggtttgcattggaagttgcattggaagttgaagttggtaccatcatatatat |
| Contig40_<br>gene_315 | 941 |
| | atgattttaattactggtggagcaggctatattgctcccatattaataattattaaataatccggttatgagactattgttttagacaattt<br>gtctaaaggacacaaaagctgtaaatgggcagtcttgtaaatgacagattttaagtgacagtgataaattaagagagatcttcaaataatg<br>atatagaggcagtaatgcacttgctgcttttcatctgtcttcagaatctgtagaagagtcgaaaagtatttaaaatatattttcaaaataca<br>gctaatctttaaggattatgaaggagttagagtaaagaaccaatcaatctcctcaactgcagcttatatgtattccaaaggagattcctat<br>aagcgaatcagctgcttatttgtctcgctacgttatttggaaaggccaatcaatcccatgagagtctaaattaagttgaaaacctattgttgagagttgagattgcgaagatctaatccagagtcagagaacatccagagatcagaacatgcgaacatgaatcaatcatcagatcaatcattgattcct<br>tgaaatatgtctcgctacgttatttctgaagaagaaacagcattcatttttggtgatgacagagagcttcaagtcaagtcagataaggatattat<br>tcatgttcaagactttgctgatgtcattcattaaagcattgaaaaaggttacaggaatataaggcatgacaggatctttaatgacagaagagaatagacttgaagtgaaggtgaaggcgcagacctggaaacgca<br>atggattttctgtaaagaaattgcagattccaaaggaagttcaaaaaagcagagaagtcttaaaaggtacaggaataggaaccagagtccagattcagattgaaagacattgttgaatctgcttgaa<br>gatatcttattgcagattccaaaggaagttccaaaaaagcagagagtcttaaaatgaaaccagagtccagattgaaagacattgttgaatctgcttgaa<br>ttggcataagaaactttcacggataa |
| Contig40_<br>gene_366 | 942 |
| | ttgaccgttccttcctattgtcaatgagcagcatctgtttgtctgaatgcaattgataaggaaaagcagtaacaaaatctatattatggc<br>agttatatttaacgtatgtcttaatttggttcttattccaatgtttagttatgatgagaggcaatatccactgtattaagtgtgaaatattat<br>tatcattttaa |
| Contig40_ | 943 |
| | atgattattattccacttagcataggtatttctctatgcaaggcttatcattgacttacttgactactctcttgcatcaactct |

FIG. 8B-129

| | | |
|---|---|---|
| gene_367 | | tattcaaataattgtttga |
| Contig40_<br>gene_368 | 944 | atgaatcaaattaaatcattttaaaaatactggttgttatctgtttcacaagtgataacaagcatttgtgcattcctatggaccataatcat<br>agccgatacctgggagtatctgattatggcattgtctcaatttgcagttcttcactggcttatggaatagtgatgattgggaataagca<br>catacatccactcgtgaaattgcgaaacataaagattttagtaagaatactctcattaacatatctcttttatttaagcttatattagccattatctta<br>tttatttaagtggattgattttgtatgtcatgggatactctcattaactatataagtactttgttttttacaatagaacttatcttcatgtc<br>tatgctactttttaaatggagtttgatttggcgttatatccagccttgaaaagtaaaatatcaagccataggagctatattaaatagcagtttttattaatag<br>gcattctaataacattaggtttgattggggcttatatccgacctcattttgaatggccacctgttgcatattcatatatttttcatatatgtttta<br>tcatatgttaaaacattcagccgacctcattttcaattgacattgtagttgtcctattggctggagattatgcaacagaatctccttggacttacaaa<br>ctccttctattctattttgtcacaacattttttgtagttaccaaagcgtaatattcctatcagcatagccatttttcttcctatgcaagaccagtggtgatcttat<br>taatatgttttcacaacattttttgtaaaatatttgtttaattatttcctatcagcatagccatttttcttcctatgcaagaccagtggtgatcttat<br>gttagctatgagcttcctgtaaaatatttgtttaattatttcctatcagcatagccatttttcttcctatgcaagaccagtggtgatcttat<br>ttacagcaaccaatactcactgcctcaactccagtccaaatactatctgacagtttcattcctattgtca |
| Contig40_<br>gene_369 | 945 | atgctaatgtctataatctgtgttatatgtgaagaggtttagaatcattaaaaacaaaatgaagaatgaatt<br>aatattaattgatatagaaatcatgaatttaattccgcagcttcagcctcaaattatgtggaaaaaaagcaaaaggagaaatattgctttttg<br>ttcatcaagatgtgaattttatgaaatacttaaaagaatgcataaaattaaaaatctttcaaattgtcaaaatctaggaattgctgagttcaagga<br>gtttctgaggaaactatgggagactattgcttataatccaaataatcgtctctggattccaaaatatcaattgtgaagaaacctgtcagattgcttttgatgaagaaacctgtatgattgcacttat<br>aacccaaacccttgacgaactattgcttataatccaaagagtattcgaagaagaaactgtcagattgtgaagaaacctgtatgattgcacttat<br>atgagcagattattgtttaaacattaaacaaaggatattcgtagttttattccaataaatatgattataatacacaaattgttatttaagtcatgaacc<br>tcttagaaatacttaaacattgaaaaagttttactattctgaaatttcaaaaggatattcgtagttttattccaataaatatgattataatacacaaattgttatttaagtcatgaacc<br>gaataatcagttaagttggatatccttttactattctgaaatttcacatataaggaatccataactaatttttatcaaatttttaacttttctaa<br>aaaaatcttaaaataa |
| Contig40_<br>gene_370 | 946 | atgcaaactgttggaatgattcttttgtggcgttttggaaaagactttaggccagttactgcaaagcgttagtgaattaaaga<br>agattatgcaatactggattgataaacaatatttattttaaaaatgctgaataaacgaggtttatctattagcaggtttacacgcaaaaatcc<br>agaacgctatggttgacgaataaaagcataaagattcattgaaacactataagcatttgaaggacgaaccttaagaacacttaatgcaatcagattaggtatg<br>gaagcacttggagaagataaacaagttgttattagaaatcaagttgcagacattaacctaaaagatgacataagtgagaattaaaaacactgctttaaagaaaaac<br>agattacttcgttacaatgttttgtcaccaagtgagcttccatatggaagttgtgaacttaaaacagggtttattggacttcggagatcgtctttgagacctgagaattaaaacactactgttttaaagaaaaac<br>cactattgattactatataaacggagaattacttcaccaaaggttattggacttcggagatcgtctttgagacctgagatgatatagaaacatta<br>ttccagtgcttgctaagaaacaaacttggatactacagaagaagatgatctctttggatgcaatcgacacatcaaaaagaattgaatctgt<br>tcaaaggatgatgaaaacaaacagacaagcttgggatatgaagagaaatgagaggtcctcattatactacataatactcctgagttgaagacagg<br>aagaaggattcagactttctttccactatcacaagacgattccattcgttcattgcagcatcggtttgtccattctattattgcaactgaaaatacaacattacaacattacgttaa<br>tacaccattttagatgatataatcagatcagaagtaaaagattattactctgttaa |

FIG. 8B-130

| Contig40_gene_371 | 947 | atgagtgaaaagaaaaattaaagtaaaatttgttgatttcaagatagtctaaaagagaatgataatttcttttatagacagtctaaaagaa
tttgatgttgaggtttcagatgtttacaaacactagattgttacaacactagattgactgttataagaatcatgtgga
ctattgaaaattatgtcctgacttcaatatctgtgattatgcattagctttatgatatcattgaatttgggacagatatcttcgttttccattt
ttcttaaatcgtcctgaaattgaaaacgttagaaaacaatagaaaaccaattgacacaagcgttaaaactgatttttgcagttttgtagt
ttccaatgaatggggagacgattatagaatccgtctgttccatgaaatcaagaaagtggactctgaggaagtctctcaataata
ttggtgacctatcggcatggccttgataagaagtttgatgcttttgctgcaggctgcattccaatctattgggagatcctaatattgaagaggaattcaacctaaatc
tatactactgaaaaaatgttgtaatttgatgtttgactgtagaggaagccgtgaaaaaataaagaagtcgaccaaaacgatgaacttatcatgccatgctaaatg
ctttataaattgtaattgatttgacttgacaatatcttcagatttgatgacttcttgttaatctctgcaatcagccttttagagaaagcctaccgt
aacctacttttttaggtgatttgaaaggaaaaactcaagacatcagtacagatttattaacagatttattataaacctattttttcttaattaagtagc
agggataggataataacacattgaattatcggaagaaagatttatcacttcattagagactaa | 
| Contig40_gene_372 | 948 | atgtcaagtcaaaatatccagattatgttgtatccatagtgaagaggatatcaaaaatattgattctaacgacattacactctctttttgt
tgacgtgcaggcaaggacaattaggctttgtaagtgacgatactggagtactggagatatactctgtgaactaacagac
tttactgatgtgtgaaaaacagccctgcagacataattggtctgttcattatgagaaaagtaaaaagttagaa
cgagaagatattgaaaaaaatattctctgaatatgatatttcttcctaaaaagacaactgtctctttaggctcagtatagtttataaacgagttgtggaagaa
ttgaactatgctaaagactggacctctgtgaagactgtttatagtccaacaatgtcctcttattgctctatatcttgatagtttataaacgagttgtggaagaa
aagatctctactattacaacatgtcgatgattatcaaaagaatctatgattctaagacatgattcttttgatgtttgatggacaaacaaactt
gagagtggacatgactgatatgtgaactaaaagtcaatggactttaggcttagctttagtccatatgtgattgattgtaaaagaaattgtaagatgggcttatgtcc
atattatatgggcttgcttcataaggatatgagagacgttaa | 
| Contig40_gene_373 | 949 | ttgccttgtaatagaaaaagagaaagccatattggaggcaatgttatacacagaggaaaagcacaatataaatgtccataagtatggtgcatat
attccacaacacaaccttcctcaatatgaacaccttctaccagatgtggggagtgaaaactccagaggagccaagcaaagattaagcagcaaaaa
aattatacaaccttcctcaatatgaacaccttctaccagatgtggggagtgaaaactccagaggagccaagcaaagattaagcagcaaaaa
gctgaggcaaatattgatgagctcaatatgaacaccttcgagagcaggcaatctccctttgagagcaggcaatatacgaaaattagttaaggatatac
cgaaaagcagtgggaaggattgcacagatctccatcctcattatcaaaagatgcttcacctttgacaacaactattcaacg
acctctatcaaggaatccaatggggatggctatggcagatgggctatggcagataggtcttattacaggagatggatgatcgatgtattatgactgactgctcttgaagcttgaatacag
agccttgactttgagtttgagacctttgagtttgagaccgtgaaaactatcaggagaaactatcaggagaaacgctgtaattaattatacagatagagaacccttataccagga
taattgagcataagcacttgagaatgcagtctgataagaccgtcagtctgataagaccgtcattaatgcagataagaccgtgcagattactgactgactgcagataagaggctgcttggaaaaggccaagaggcatac
tatcctatgaatgtgaacactgggcagtgcagttgtaatgacactgtatttatgtaatgaagaaaggcaatgtaatcttggcggaagcttgg
gatgtagttagtagtagtggcagtgccaggttgcattgatgaggcattgagttagttaaatcttttagaatag | 
| Contig40_gene_391 | 950 | atgcgtttaggttgtagataagtcagtcagttacaaaaatatccatttcagattggttttatgattcaattaaagcatataaagcatatagattgtcttcagagct
ttgtgacaatttcaatataaagaataaaggacctgttcctaaaccctattcctattctattaaactgataagcttatgctatgctaagcagaaaaatcaaaag
aggaaataagcaatatttttagaggaattgataagtaagaagaaagaatatagactaaaagtatgatgtttgaagtataagataatctttaaagaccaccaaaatta
ttattaaaaataagaatcataa |

FIG. 8B-131

| | | |
|---|---|---|
| Contig40_gene_450 | 951 | atgaaaatagcaatggtagtcaattccaccccatatcgaggagttggagtacatatacacagcctagcaaagcctaatcaggaaggcca<br>tgaagtatatgtgattacatacctcacaaggacattaaggacattcatgtcattgaacaagaatcatgaacggaataaatataccaggcctta<br>gaggattgatgtttggaattaatgccagcgtgaatgctggaaaatcaacaaatcaaaaccatgtgactgactgactcagatcagtatcttgaaatgtataaaaaca<br>gcaggatggccagcgttaaggctggaaaatcaacaaatcaaaaaccatgtgactgactgactcagatcagtatcttgaaatgtataaaaaca<br>aaaatttatgaggccttataaagaaaagttaagatcttcattgaattcagtagagaataacaaaactacagaagataataaagattg<br>atgttccaggcataaagaaaagattaagatcttcattgaattcagtagagaataacaaaactacagaagagaataaggataagtttaaa<br>aaggaactgttaatgaataactagacccaataagccaatgattcttttttgtaggaaatataattaaaagaaaaaatgtgaatctccttgt<br>tgaagccaaaagactaattaaaaccgatgcaaatcttacttgagaagaggttctgaattaggaagtctatccaagctgtgactctaccaagctgtgcttcctcttagcgaa<br>ataaaatcatgacgttgttttaatagaagcattagcacatggaaatgcagtcattgaagcaatacaggcggaataaagagatatcacagaagacgt<br>agttcgacttgttttaatagaagcattagcacatggaaatgcagtcattgaagcaatacaggcggaataaagagatatcacagaagacgt<br>tggattattgattaatccaaatgatagccaagacctagcaattgataagatacttcaggatgaagaat |
| Contig40_gene_470 | 952 | atgaaaatagctattgtacttggaacaagccgaaataataaggtcttctgttatgatgaaattgaaaacagagagtcatgaattgttatt<br>aatccacacaggccagcattatgatcaagaaatgtctgaaaactttcttcattgacttgaaactcttaccccaaattataacattcatgtaggct<br>ccggctctcatgagctcagacagccgctctgtcagcagactcgcacttgtcgagcagacatctgtcagcagcagacatctgctgatcagacgcttaagatcatttgatgagactat<br>acaaatgcagtcgcttcagcgcagactcgcacttgtcgagcagacatctgtcagcagcagacatctgctgatcagcttaagatcatttgatgagactat<br>gcctgaagagatcaaccgcttcaaccgcttcataacgtaatactttgtccaacagaagaatcagcaatcaacttgctatggaagga<br>tttccagaaaaagaatcttcataacggtaatactgatcagtgatatcctcaccctaacaatgcataggctgaaaccgttgacgataaggaacgcct<br>gatgaaggccttcaggaattggatatcgacataatgtaagatgacatgaagaattaagcgacatgacatcctagaactaaaaagacaatgagaacttcaatc<br>aaccaatataattgaagctctgaagaattaagcgacatgaagaattaagcgacatgacatcctagaactaaaaagacaatgagaacttcaatc<br>tctttgacagatttaaaacgatctccctcatgttcataactctaagaagcgactctctaagaaaagatcttttgcattcgcactacaatacagagcgtcctgaaacagtaac<br>ctaacagattccggcggaacatcctgtaggttccgataaggagtgatacttgaaaatgcaagaagatcttagatgatg<br>tgccggagggaacatcctgtaggttccgataaggagtgatacttgaaaatgcaagaagatcttagatgatg |
| Contig40_gene_653 | 953 | atgtataagatataataattagtgttaattcctgcaaggaggatccaaaggaattccgcgtaaaaacatacgtttttaggtaaaagcc<br>tctcattgcacacacaatagaaatggaaaggcatccaaatatgtgatgagctagtttgtgacaactgacgatgagctagttcatcagcg<br>aaaaattcggagcagaacaatcaaaaggatggaaaagctagctgaaagactctatcccacttgatccggtaatctacgatccgcaattcaaaag<br>gaaggaaagcaatgaaaatatgatgttgtaattaccgtacagcctacttcccattgcttaagacaaaacctagattagctattgtattgaaaa<br>actattaaaccccgacaatgaaaacaagattatgacacaatcataagtgttgtagacgacaggcatataaggaaaccggaagcattttgcaacaagaagagaa<br>aaagtatttccattatataagaaagggtaaaccgacaatcctcaaggcatataagaaaccgaagcatttgacaactatgaggactgtg<br>ggtagctgaaaatcctaaacacgaagcgtcttggagaaaatatagtctattgaagtatcaaacagaaagcatagacattgacaactatgaggactgtg<br>tagcttcaaagcttgtaaacaccaagaagctgatttttccttcttgatgaggctcaggaattggaatatagttaaaaacaacaactatccattc<br>ataaccatatcaattccaataaacaccaattcaaatacaacaaagacccttaggaggtataatgtgaatactaga<br>tatcataatgacatactaaacaccaattcaaatacaacaaagacccttaggaggtataatgtgaatactaga |

FIG. 8B-132

| | | |
|---|---|---|
| Contig40_gene_654 | 954 | atggaatcaaaagacattacaaatattgaagagattataccaagcaatgacgtatatccttagtaatctactattccaagcaaactcttcaa
atcaaagaaataaacacaaacagccttgcaatcagctgtcttgacctaatcgacaaaaacagaataaaatcacattcaatgagaaatcgaat
caatcaaaatcagcaagaaccctcttcttaagacaaaggccaattgaaaaagaattggaactcatgaaaaacatcaaatttacaatcaattca
aaagagatgaaaaactgataaagagagacaaatcatcttgaagatgtttaaggacatcaaaaaaccatgaatttgacttaaaatccatgta
tgataagatcctaagcaggcaggatatagcaatcaaattgcaaaatacttcaaagattattccaaatcccttgaaaggaaaccaaatactcattgg
aaaactataaagacctcatcaaggatggagagtttaccttaaggaaatgaaataagcaatgaatgaaagaattcaaaagctctttaaaatca
gataagtccttatacagccaagactacgattcagagcttcagagcttcccaaaagattccttatttgaagatatgcctgaaattatgaaaaggatgttctaaaaacat
tgaaaggcaaatccagatccagactacgttgaaaaggagacgttcagtacctgttggaaacagcaaatacttcgtccgattcggataa
caaacagcaagatagaaagaaagagagacgttcagtacctgttggaaacagcaaatacttcgtcccagattcggataa |
| Contig40_gene_655 | 955 | atgaccatattcaatgaagaaccattcctaatagccgaaatagcgtaaaactactacgacattgcaaagaaggaaaatatatccaatatgatgc
agctaaactaattgttaaggaggctcatgacgcagcgcaatgcaatcagcagttaaattccaatcatataaggcaaacaccatagcatccaagaattctc
cagcatattgggacacaacagaagacgtaccccaatcacaatacagcaatctcaaagacttcaagaagttcgactccttgagaggcagaatagggaaatc
gcagactactgcaaagaaatcgaagacccttattcctatccaatcaacacctttgattctcaatagactatctcaccggagcatcaacccttg
aatatcatcctcagaccttacaaacatccattcataaaaagtacgcaataaacctttaataacaagaagaagcataatcatatccaccggagcatcacttgtctctcc
atgaagtaaaactagctatagatgaagtgcaaatgtcaaacgctaacgacaaatagaaaacgcttaacaaatcacttaaacctttattcagatacacaa
gccagtgagaatatgctcattcttacaacagcctatcttttatgcgccactatccttgaaaaagcactgataaaaaactagaacatagcaacttgatagata
acgaccactcatgaatgaccagataaaaacaggccagagcttcaattagaaagttcaacaaaacatagaaagtctcaagaaggaaatccgtgaagcacaataatcacagaggatat
cctctccatgtgaagagaaatcgtgaactggcattctccaagtgaatgagcatcaagttgaagaaataacaataatatgtgctcatcatgagatcactaaatatggaagaattcagatacataaaataa |
| Contig40_gene_656 | 956 | atgactttacagtaagaaataaactcaacataatgtcgtctcttgaagagaaataaacaagagattcaaaggctgtcatccatg
gcattaatcagaatgtatctctactagaataaccagaaagacaaatgtcttgagtcagctcagctccaacagtccagtcttcctaagcgataaag
taaatacattccttttataaatgggaatacaagcattctctataaagaaatggcctcaaacccttaagcggaaaggatacaagatgttttaattattccagccaagaa
aaagtcatatattaaatgggaatcaagcatctatagctatttctaaaggacatctcaataaagcattccttaataacaataagagcttgaaacaataggacattcaaatagaatc
ccatatctaaacaatcatttcagaagcagtgcaaatagaagaagaaaataatgtcaataacaatgaccgaatcctttaggtctctttataaaca
ataatctatcatattattgaaagaatcatagcatatggccatttggaaggatgcagcatgcagaaggatacttcttgaaagaaaggaaagaagcaaagca
agtctatctgttgttagcctattaggatatagtaccaagaaattgcagcatgcaagaaaagaatatagaaaagaaataggaaattgaattataatacagcatgaaccataa
gtccataaccatttaggatatagtaccaagaaattgcagcatgatgaacatcaagaaaatgtaatattccctgataaatactaagt
tttggtgactggcaaatcttccaagctgtcctatagttcctatagctatttctgttctttccataacttgaagacaactctaaaac
ttttatgaagatggcagatgaggataaaaaccaaatctattcatttcacaaggagtatttgaaaat |
| Contig40_gene_657 | 957 | Atgtgggctcaagtaaacactaccacctgttccaaacatgccaacctagttcttccatacacagtcttcctattcatacacatgtactgtgaaaa
ggataaggaaaaataagagattccttctatccatgatagcctgacattcatatcaacagtgatcatctgcctattgttttttaatatttggac
acctattgcagatgcgctctttatgaagcatgcaggtattgtacatcacaactgcaatatccttcttgcatgcatgaacctaatgctcata
aactactttagaaccttcaggaaatgaaaatgaaaagatattccctattctgttctttcaaagctatctatatagggttttttgtaagcatctactacata
tgcaggatacaatagaacagttgttctcggtctttaacaggctatgcagcagtattccatgatgtcaggcagtattcatgatgcagttctgtgtaaggcatcttg |

FIG. 8B-133

| | |
|---|---|
| | gattcagctttggaaaatggtcaaacctaaaggaacagcttgccttgccctt ccaaccattccaagcaatgttcaagctgggtagttgattca<br>agcgacaaatatgttattggaatcctttaggtcagtgcagtggcagtgcattgcctattcaccaggatatgccttaggaacgatatgcctaatgttcct<br>atctccattgcagttctcttccaacgattcttccagagcattatgaaaggagattgcagaggtagcaaatatctcagctattcaatga<br>aatactatctcttctcactgtgccagcagctgaggtagcagtgagcgtactctctaagccatctttacatactaacaacccagagattgctctt<br>ggaggttatatgtaactccattgtgctctagtgtcaattcatgggcaataaccaataatataactttatactagaagaaaacac<br>aatgaccttggtaaattatgatcatgtagccatatccaacattgtttaaatctgattcttgtgccttatc |
| 958 | atgaatattttacatggctcattcttctatccatgtctgctgaaggagtagttaattgtcaagttatcaaattgctttaaatcaagtaaa<br>agataataatgtcatgtttacacatcagactcctgtaagcaggattgaaatttgaagatgtcgttatgatgtagatgtgatgagttaaag<br>ttgattacttagaaatctgtcaaacagattaaattagctaccatgttccgcttatttccgcttatttagaattagaaagatataaaa<br>aatcatgacatcattcatattcacgaacatagccacctagctattttagtaagcacatttttgatatggcattgatttaagatacttcatatgcatctt<br>ggcccatgatctgtactccttctgaagtggaaaaggagcaatacattaaaatgggagtctctgaagcaagatgaaatgcctttggaaataaatatt<br>gtgtatttgcccctactgaagtggaaaaggagcaatacattaaaatgggagtctctgaagacaagattgaaatgctgaatagtccctttggaataaatatt<br>gaagagtatgagaattgcagaacctgaaagttccgtcaagttccaatatcttaagtttccccctataagttagctattgtagggccagatg<br>tgaaatcaaaggccttgatctattgattgaatgaaggatagcagagatagctgaatccaagtaatcttacaacaagtggctcggggaagaaagcat<br>atggctattttgacacttgaatgaaggatagcagagatagctgaaatcaagtaatcttacaacaagtggcttgaggcaatgccttgtgccaagcatt<br>gaagctttagtgactgtgacttgtttgtaatgcttcaaatatgaatcttcaaatatgaaaatgtaggcattcctgtgatgatgaaa |
| 959 | gtgctaagaaagtttgattattgtaacaggcagaggattgccgaggattgcattgaatgtttacaatgccttaccaaacgagg<br>aatggagtgtgagatagcattggatgaatccgcaccagttatattgtttaaaagaacaatatgaatgaataagttatcattccacaggctg<br>gaggccattctgccactcttaagcaactgtaaacgctgcaacacgtctgttaaggctctgttaaggctaaacaagaagctaatcaagaaagaaa<br>ttcgatctggtcctggaaatccttgagggagcaatcatagtggtgctcttgctgcaaagataaccgaacccttctgtaagccttaatcac<br>tccttgacactgaactaagatgcggaaagatgcgaaactagtcttgggataagaaagggcccttgataagttaaatgaacattgcagtgaacttaagaag<br>taaagtcctctgcctgtaaatgacaacattagtcttgggataagaaagggcccttgataagttaaatgaacattgcagtgaacttaagaag<br>aaaacccagatgcaatggagtttgacccgctaagcaactggtcttatgtgagatcctctagaagagagtttataagtatattgatgaaactaagataa<br>ccagttttcaaaatacagtgacagattcaactggtctttcatcttgcagaccttgcaatatgacagccttatgctccatgaggcatg<br>tcaatgtaggctttatagacctgggtcattcttaaaagggtgaaatgatcttgtgtgcaactatgacattactatactgactacct<br>gtgtgcaatctgccggtggtcattcttaaaagggtgaaatgatcttgtgtgcaactatgacattactatactcaattgatgtga<br>cttggaagaccttgatgaggcatatttgatgtgtgcaactatgactatgtaaaaatacagctacct |
| 960 | atgagcgaagagtcaagcagtcaagcagttcaaaagcacgcaattatcctaataggaaacgttatcttccgtgtaggaggatatatctaccg<br>ctttaatgcttcccttttaggacctgcgcatatgaaattctcgacttacaactccttccaaggatcttcaggttctctctgtgcag<br>ggcttccaattgcaattgtcaagtatgtatctgaattcaatgccctgatgagaaggacctttgcttgccgccaaactattttacgtccctaagatt<br>atgtattcctaggctttctctcaggctgtaggtctcatcaatgttgattcataatggtagcgcccaataacaacaacaaggactcttcc<br>attgcaggctgtagtctcgaacatctgcagtctacatctttgattctttcggtttatcgttgaagattcgtgagcctttggattatcacccttgtttctttgattatccacccttgtcgttaggttccgtt<br>atacaagagctatcgaacgatatttcatgattctacatgctacacactctttccaagatataagcaaatctccgcaaaccccagactttaagttcc<br>ttagttttgtagcatctgcaatcctcgcagttctacatcttcaaagatataagccaaatactacatccgcaaaccccagactttaagttcc<br>attgaaggacgagctgaagctggctaagaactggtgctaagaactggtgcaactactctgttatctacagtatct |

FIG. 8B-134

| | | |
|---|---|---|
| | | gcacacttcttatggagccttcctccctgcagctgcaatcggatacttacagcagcagacccctatcgcaagcttccttagtcgtatcaaat<br>tccctgctacaacaatactgcctgcaacatctgaagcatatgcttaaggaccaagtgctcctgaaaaatatgtgacagcaccataagta<br>tggaatgttctttgttattccaatgtgtgtaggaatagctatcttcgcaagagagaataatgggacttgtatact |
| Contig40_<br>gene_960 | 961 | gtggttataccagccttcaatgaagaagcgactgtagctcaagtggtaactgtagctcgcaagctatcatatataagcgaagtcatagtggtga<br>tgatggatcaactgataaaaactgtagaggaagcggagaaggcaggagcaactgtcataagccataaagccaccaagtaaggggtagctatca<br>aacagattttaaaaattccatggtagatagttgcctttatagatgcagatgtatccaattcactcctacaaagatagacaagataatcaag<br>cctattttgaaggtaagacagcattacaaagaccaaattgcacggaaagtggccgttctgcactattgcagagaagccttactgcaaacctctttaagttt<br>ctttctccctgaattgaattgcataagtctgatgcctgttgatgttcattggaatagaacatttggaagttgatattggaacattggagacattgaagacttttatgccgttcacttaggactatg<br>gtgtgatgtggcattgcattgatgtctgatgtctcattgatgacaggcagttgattagtgccgtgtcactatgcctgtcactgtgatacccttgaaa<br>gccgatttaaacaaatgccatcatgggattgtccctattctcattcttgactgttcatgatttctttgtccattcattccattggtcatatccgttt<br>ttatatcagaatgcccatcatgggattgtgactgactatagccttcctgtactagtgctatcaggccttatgttcaaagtcaattcctatttcaaagtcaattcaagggatacaagtacg<br>tagtgctcttgttgaattgcactgactatagccttcctgtactagtgctatcaggccttatattcaaagtcaattcctatttcaaagaagggatacaagtacg<br>gcattaaaagtcatttgttaagatgcacttctcaagaaacttgtatattccccttcagatgactatcatcaaa<br>taatgatgcaggatatcagttgagctttactcaagaaacttgtatattccccttcagatgactatcatcaaa |
| Contig40_<br>gene_967 | 962 | atgaaaaccagaattagtgtcatcattacaatgttcatgaatctcagagttcatagaatcgtctgtcctggcacagactctgtctggcacagactctgtctggcacagatcgtagacactgcttgtgcaagtcttatg<br>ttggaccttgtagatgattatcaaagaaatcttcaaatcattttagtggatgacggctcaccgacgacagcggtgaaattgctaagtcttatg<br>cagcaaatatgaaaatgttgaatacagattaggagaaaatcaaggattaggcatccgatgcagaaactacgatgcgaattttgctgaagggactat<br>atcatttttatagattcagatgacatcattcctccaagggcatatgaaaggatgtatcgccttgcgcttaaaaatgacagcgaccttactacgg<br>atctgtatggcgatttaattcaaagctgacttggcttccaacattcaaattttagcttttggaaaagacagagcttactcacattaaggaaa<br>gcctgagctatttttatgacacactccagttacgatgcctatgcattgtttcaatagtctatgaaaactgctatttatgggaagagtgaggatgg<br>tatgaagacattccagttacgatgccatgatgcatttcaataggctaatattttggcaacaagcttatcaaaatgttcaatagctatgaaaactgctatttatggagagtgaggatgg<br>aatatccaaatcaataactcaaactacagatgcataggtaaagaatttgaagacgcagttgaagaagaaacgatttgatctcatcaataagctaaaaagcatgacata<br>atgtcaaggaagaattgcataggtaaagaatttgaagacgcagttgaagaagaaacgatttgatctcatcaataagctaaaaagcatgacata<br>gacgagtcttcaagaaatcattgaccctttgcttgattgatatccgaccgtaacatagcagattacttgatgagctaaatactttaattatgagcatgttaatttct<br>caagtatgaatattgttgaaaggatttgacagattcttacgaatttcttacagaggagtgcctgaatccgtcgtaatcagacattactacata |
| Contig40_<br>gene_969 | 963 | Gtgatcattccattatatgtttacgaattcttacgaggagtgcctgaatccgtcgtaatcagacattactcagtcgactgactgacgg<br>atatgaaagaatcttcaaataatactgatagattacgagagttccagcctctataatgccaaaagaatgccaaaactacgaaaaca<br>ttgaataccaccatgaagtcaatcaagattaggccatgccagaaactacgatgcgaattccagaagggactacataattttcctgattca<br>gatgataagcttttctccaaatgcctatgatgatgtataaaacagccataagaaacgatagcgatatgaccattgcagatgattgagatttaa<br>ttcaaaaaatacaagatttcaaacattaataacatttcaatgaaacattaatagcttcaatgaaacatcaagcacacatcagcgaaagcccagaactctttatg<br>atacaacgcttgaacaagctaatcaagcacagcttctgaagaacataattccagttccgaagaatactctatgaggaagacatacctgta<br>acaatacctatgcattctagcaaacaacgttctcagtctacgaaacaacgttcttatgtctacgaaaacacgttcatgtctacgtggtgacaagtttgcatgaatgttgatgaaggc<br>acaaacaaccaccgaattaaaaatctcgaaaacaacgttgtcatgggctggtgacaagtttgcatgaatgttgatgaaggc<br>tccgccatgtaaaaacaatgaaatggcttaaaacgacctcctatttttattagaagcataagaacatgtaagaacatgtaagaacatggatataaata |

FIG. 8B-135

| | |
|---|---|
| | atgtcactaatccgagattacatccaaataacatagatgctgatgaattcaagtacttgaatgatgaaggtattaaaatatgaatatctgat<br>ggatgatgaaattgacaagatagttcaatattgaacttcaaggctgaaatataaaggagacaaaggtctatc |
| Contig40_<br>gene_970<br>964 | atgcaagatcctaagatttctgtaattattccaatatataatacagaagactatatcgaagagacattactgtctgtaattaatcaaacaatctt<br>tgatgagatagaggtcatcatagttgacgatgagtcaacgaatatcacggaatttatgcctatcaaaatccaaaggagaatacatcatagagaaatacatcatagagaaatcaaagcaatattcaag<br>tttccatcaaaagaatgaaggcaggagaatatcacgaatttatgcctatcaaaatccaaaatgaaagcgatattgtcatagagaatgtcttagactctgatgat<br>tatctgccaacagcatatgaaacactataataatgcatataaaaatgcatataaaaatgactttgatgaagacatgcattgttcatcatgagcttaaacgaaggcttccatattat<br>caacgtatggaagagagcttataaaagttattcaataagttatcttagctgtcatcctcatttcaaagagaaatcttcaaatcttccactattggagatcttgaaaaatcttccaagacatt<br>gggataccctgtaacaaatagttatcttagctgtcatcctcatttcaaagagaaatcttccactattggagatggagatcttgaaaaagtacgaagagagg<br>ccattttcactggaaagttatatctttagctgcattaaggaacattggctaagaaacattggctaaaatgctgaatcatgaccgcctaagacctgaatcatgaccgtgaatcatataccagatgcgctagaacagctgcaacagctgctgaatcatataaggaatatcatgaagaa<br>cacacaggacaagagcctaagaacattggctaaaatgctgaatcatgaccgcctaagacctgaatcatgaccgtgaatcatataccagatgcgctagacagctgcaacagctgctgaatcatataaggaatatcatgaagaa<br>agataaggaattagtagttaaaaatctcaaaatgcttaaaatcaaatctcaacatgctgaatcatataccagatgcgctagacagctgcaacagctgcttgaattcatataaggaatcctgaaattcat<br>ttgtttgaaggtctatggatagttaaaatcaaaatgcttaaaatcaaatccaaaatcaaatcaaaatcaaaatcaaaatcaaaatcaaaatcaaaatcaaaatcaaaatcaaaatcaaaatcaaaatcaaaatcaaaatcaaaatcaaaatcaaaatcaaaatcaaaatcaaaatcaaaatcaaaatcaaaatcaaaatcaaatcat<br>aataaggattatgagaatttcctcctgttttgcaccttt |
| Contig40_<br>gene_977<br>965 | atgatcggtgtaatattagcagcaggaatggcacaagatggcacaagatatgccacaagatatgccacaagatatgccacaagatatgccacaagatatgccacaagatatgccacaagatatgccacaagatatgccacaagatatgccacaagatatgccacaagatatgccacaagatatgccaagaagatatgccaagaagatatgccactac<br>cttgctgaacgtatgttaacactgcatgattaaaactgcatgattaaaactgcatgattaaaactgcatgattaaaactgcatgattaaaactgcatgattaaaactgcatgattaaaactgcatgattaaaactgcatgattaaaactgcatgattaaaactgcatgattaaaactgcatgattaaaactgcatgattaaaactgaccatacgact<br>gccccgaatagctgaaaatatgataagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaagataagaaga<br>agcaaattcattgaagaaaacgacctgattctagtaaagacattctagtaaagagacattccaagctacaaggctcgcagtttc<br>acaaatacaggcatgataatagataacttcaaggagcttaacgaggaatcattccaagcttaacgaggaatcattccaagcttatccttatcgatgaatccttaatgaagacaaga<br>caatagctaacgcaaaataacttcataggagaaaagttaaggagaaattaattgaagaggaccctcaaaactattatgactttgcttataagactttaagtcttatcaa<br>gacgtagccaattcaataggattttgacaacgattaaaaatgaccgaaatagatga<br>gaccattgacttgtgttgtacaacgatt |
| Contig40_<br>gene_978<br>966 | atggcagagagaaagaagcttttaaaaactaatcaaagacatattatacatctcagcaaagcgcagcgctagagcactatatattggctc<br>atacattatccctgcaaatgaaaataattctatttgaatcaatcaatccaatagcgcagcgctagagcactatatctatgaagaatcg<br>tcagccaaggcttgacaaggagtacacattgctagagacttgctcttcatgctgtgctcttcatgctgtcatccagaacatccatttcagcagtcagcatccatacaagtcaatgcagcaaaagactcctagcctaccaaagacattccattatttggtcaaggagaatattcaaaatccagcagtcagcaaaaatgcagtagtaaaacccaata<br>tttttaaaaattcctataattcctataattcctataattcctataattcctataattcctataattcctataattcctataattcctataattcctataattcctataattcctataattcctataattcctataattcctataattcctataattcctataattcctataattcctataattcctataattcctataattcctataattcctataattcctataattcctataattcctata<br>catccaaacatgcatgaactcaccaccaccacccttaaaaagcttgcaatattgaacatgattacagactgattctcatcaaaacaaagaataaaaagacattccaagacattccaaaacaccaccg<br>aggagtttagaaaaacacatccgcttgcaatactccaccacccttaaaaagcttgcaatattgaacatgattagcaatatgacattgcgaatatcaaaacaaagcatccaaaacaccaccg<br>gagatgctgaataggatatcctatgattaaaagcttgcaatactccaccacccttaaaaagcttgcaatatcaaggtctataccaaagccaatacagttcaacagaatacagtcaacagaatacagactccgaatacacattagactccgaatacacattagactccgaatacacattagactccgaatacacattagactccgaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaatatgcattgcaaaatggactccg<br>ttccatattaaaagacctatgctcttttgcatatgctcttttgcatatgatctagatgattataaaaacaatcttaggacttttt |

FIG. 8B-136

| | | |
|---|---|---|
| Contig40_gene_111_3 | 967 | atgtctattaataagtcaaatctaattaagcctaaaaatataacttaaatctttattagtggcaattccaataaaagcagatatcaatccaa<br>actaataagggggacttcgattcactcctgaatatagcatatgtcttgaaggcttcctacacttttcacagactttgtttcaaatg<br>agcttagatatttggttgaagatggcttcaatgtagttgtattctgctatatggactactattggactagatagacatagtgcatacctgttgatttgaagta<br>attcgcttgatgagtcagatacatttccccgtttgcgataggctggaattccttttacagtatttgcacatgctgttgacatcttcaaatatgatgtcg<br>tccctgtacagaatatacattcccgtttgcgataggctggaattccttttacagtatttgcacatgctgttgacatcttcaaatatgatgtcg<br>ataaaattaataggttgatgaatatcataatacaaggcaggctactgactatgagatagaggcttgaattgaagagaggatgtgagaaatattgt<br>ggagtggataaggataagattcattacaaggcaggctactgactatgtcttgattgagtgtgcagacattctaaggatgagatgagtttccatctatg<br>agcatttcccgttttgtgaaaagaaagcatatcaaaggcagatatattgcgtctccatgcagaatagctgaaatgcgatagggatgaattcctacggtcatatttga<br>gatttggaggacttctttgataaggcatatcaaaggcagatatattgcgtctccatgcagaatagctgaaatgcgatagggatgaattcctacggtcatatttga<br>gtaaaagaggtctttattgagtgtgttgactacagaggtttcagcaatacctgaagttattgatgatggaagga<br>ggcaatggcctatggagtgtgttgactacagaggtttcagcaatacctgaagttattgatgatggaagga |
| Contig40_gene_111_5 | 968 | atgaccaaaccaaaagtttccatgattttatcagcatataatgaagagagattcatcgataaggccatatgcagtctaacaaaccaaagccttaa<br>agacatagaataatcataataaacgatgatccaccgaagcaagcagacaatcatagagaaatcatgctgaagagaccaagaatcactgtaa<br>taaccaatcaaatattggcttgagcaagcatacaatgaggcgaaatcaaaggaatgcaattgccaaggagaatatgtggattcttgatggagtgactgg<br>tacagattagatgctcttgagatagcatcaatgaggcgaaatcaaaggaatgcaattgccaaggagaatatgtggattcttgatggagtgactgg<br>aggacgaatatacgaaaacgactggtttaatctaaacaaccttgatgaaagcttgatgtatagtatttacacctgagaaaacaaaagacttc<br>tatttgactttatcagtaagttcatgcaaagatctatagaagaattgattttaaagtcaataaaatgcaagctttccagaaggaatctatttgaa<br>gacatgccttctctctctttatgtctatcttaaggcagagagaatttcaataatcagacatcattttattacagacaatggtctatgatgactata<br>caccatgtgacccttatccgcatacaagatatagaataatgtccaagataaacagaatatctggatactgtccaagatggcgctcttatgaggacataactgaagatgctaagactgaaga<br>agtcgacccttatccgcatacaagatattgtccaagataaacagaatatctggatactgtccaagatggcgctcttatgaggacataactgaagatgctaagactgaaga<br>gaagactatgagaagatattaaaaagaacaatccagaatattag<br>gtatgcaattatgaggaatttaaaaagaacaatccagaatattag |
| Contig40_gene_112_0 | 969 | atgaaaatttgtattgtaggacaaggatatatcgattgccaactgccagctgcagctgctaaagtggctgtgaggttgtgtggcgtagacataaa<br>taaggaaatcattgaaaagctaaaccaaggaataagctaatagaagagcctgaataagcgactcaatcaaaatgcgtagaccaaggccatt<br>atcatgcttcattaactcctgaggaggcagacacattcatataaccgttccaaccccatatttgcctgaggatcttagctgtgacttaagctat<br>gtaatatccgcttgcaattcctttgaaaatgaagctttcattggagagaaccctatgtcgttcatcaatcaacaatagctccaatgtctacgatgagt<br>aatcaagcctatctctttgaaaatgaagctttcattggagagaaccctatgtcgttcatcaatcaacaatagctccaatgtctacgatgagt<br>aagagcttgtaaacaacaacagaatagtaggtgaatcactgaagatgtaatcaaaatgcatgaaaatgcagaagactgaagagcttaaaaggagaa<br>ataatagagactgaagcaagaattgcagaattatcaaaatgccagtgcatgaaaatgcagaaacacctgcatagaccgcacctgcaatgagcttgctaa<br>gaggccactgccttgcaatgcgtaaacgcgtcaatgctgaaaagattcatctatgcaaagatttcatctatgcaaaataaccgcaaggatacaaataacagc<br>atgccaggttttgtaatagagaattaccggaaaagattcatctatgcaaagatttcatctatgcaaaataaccgcaaggatacaaataacagc<br>aaatacagacgatgcaaggaaaagccctgcatttgagataattgcaggactgaagctgcaggatatgaagtgg |

FIG. 8B-137

| | |
|---|---|
| Contig40_gene_112_1 | 970 | atgaggatttaattacaggcgcttatgtgaatgttaggatctgacttagaagagaggttctaaaaatcatgatttaattgcaacaggctctaaaga<br>cctagacatcacagatgaagaaagatgtattgatttattgctaaagaacgtccggaaatagtcataaatgctgcagcttacactgctgtagatg<br>actgtgagactcattatgatgatgcatatgcagtaaatgccctaggccctcgtaatttgcaatagcctgtaataagattgatattccttt ggtc<br>cataagcacagactatgtctttgatgaactaagcgaactcctcttatagaaaatgacaaattagtcctcaaagcatatgaaagaccaa<br>gcttgctgagagagttcattcaggaaaaacactcaaaaatacttcattcttcgtaccgcttgctatatggaatccatgaggaaacttt gtaa<br>agaccatgttgatttgctaagagaacatgatgagataactgttgtaaatgatcagataggtctcctacattctctcttgatttggcaatgca<br>atatgtgagttctagacagcgataagtgatgcatctcacctacaactgaagagttccaagcactgaagagtcctgtgatgatttgcaaagaatctttag<br>aatatctgatattgatgtgaagtcataccgtaagcactgaagagcttccaagcactgaagagttccatagcctgtatttcgtattaagcaatgtaa<br>aatgaaaagcgcagttttgttccaatgagagattataagaagcttgaatcaatatattcttatataattttt tgtaaaatagg taa<br>atttaa |
| Contig40_gene_112_2 | 971 | atgaaagaatcgtttagctgtggttctgaaccagattatatccaattacaaaggctgttctaagcagttattgccttatatgataagcc<br>aatgattattatcctatctcttgatgctagcgaattggaatatatcctgctgaagagaatcctaacggcttgctgaagcattcatcataggggaagac<br>tgctagggatggaagcaattaggaatgtcctttcctatgctgagcaagagaatcctaacggcttgctgaagcattcatcataggggaagac<br>tttattgcgatgacaatgttgctctctatattggagacaatattttccatgacacagattactgaaatcctagaaagagctcgtgatcttga<br>tgatgagcggtcatattcggctactttacaaacaagccagaggcttttgggtttgtgagtttgataatgaattgtttctccatagaag<br>aaaagccagaacaactctaaatccaatatgtgttccgggacttttattctatgagagttcgcgaggttagtgcaagagtgaaagccttca<br>gatagggagagcttgaaataaacctctgtaaatgaggcaagcttaaggtagagctcctaggtagaggtatggcttggct<br>tgatacaggtactcatgatggcttcttgaggcagctaattctcattgagacagttcaaaagagacaaagtttgtatattgctgtttggaagaa<br>ttgcttattccaaggdatatattagcaaagaagagcttttaaaattagcagagcctcttaagaaaactgctattagtgattattaactaaatta<br>gcagaaagaagatttaa |
| Contig40_gene_112_3 | 972 | atgggcaagtttaatataattaaaagtgaaattgaagtgtattacagttgaacctacgttttgaagatgaacgggctacttt atggaaac<br>ttataatgagaatgacttaagcaggcagaggagttgatttaaccttgtccaagcaatcaatcaaagtcatcaaaggtacttagaggcctcc<br>atttccaatacacacagccacaagaaagctggttcgttcgtgtaataacaaaaaacagttatttataccaaaaggatttgccatggctttttagtattatcaga<br>tatgaaaaatgatgggggaaatactctctgaagaaaacagttatttataccaaaaggattgccatggctttttagtattatcaga<br>tgaagcagaattcgttacaagtgtacagatctgattctatctgaaaaggacaagctattgaagccaatgaaagacactccaactgatttctatatgaa<br>cattgggagaccttaaggagaagaggatctgattctatctgaaaaggacaagctattgaagccaatgaaagacactccaactgatttctatatggaa<br>gatgaatga |
| Contig40_gene_112_4 | 973 | atgacaaaaattttagttactggcggtcaggtttcggaaacctgtaagtagtaactttatataaatatatgcttgataagtatcctgattatgaaatagttaa<br>tttagatgctttgacttactgcgaaacctttgaaaatcttgaagatattgaagataatccgaattattccttgttaaggaaatatcatgatg<br>aagtcttgttgatgtgttgtaagcagcgtagactacagtcaatttgcagctgaaagcatgtgaccgcagcatagaagaccgcagata<br>ttcatcaaatccaacataatcgaacacaggtactttcacgaaacaactcctccaggcaaacagcccatattcagcctcaaggtatccacgacaagt<br>atatgaagcctaggccagagcatatggagagacattcgacctcccatcaacatacgagacctcaaaacaactatggcctatcagt ccagaaaactgata<br>tggtaagagcatatgagagacattcgacctcccatcaacatacgagcgaccaggaaaaaacataagagactgctacactatacgaccactg<br>ccactaatgatctccaatgcctagaagacaaggagctcccaatatacggcgacgaaaaaacataagagactggtgccacgtctacgaccactg<br>ctcagctattgaccctttgttctcccacaaaggaaagctaataccatttgcggccacaacatttgcggccacaacatatagaaatagtaaaac<br>ttattcttaaggaacttgataaaccagaaagcctaataaatttgtaaaagacagattaggtcatgacagacgataggtcatgacagacgcatgcaatagattcaaccaaa |

FIG. 8B-138

| | | |
|---|---|---|
| | | ataacagaagaattaggctgaaccaaatacacatttgaaacaggaatagtggaaacaatccattgtatttgacaatcaagactggatgga<br>aaagtaaaatccggcgaatatcaagatattatgaaaagatgtactctaaaaagtag |
| Contig40_<br>gene_112_<br>5 | 974 | atgaagtatcagtagtaacacctaactataatggtctcttaaattcttaaacgcctatttgaacccttagctttcaaagtagttcatagaaga<br>gatcatcataatcgataatcgatcatctactgatctgatgccagctgtgatcaggtcagtcaatcaggcattcgctcctgcaggcatcaatcaggcattcgctcctgcaggcatcaa<br>taaaaatgataaaaatcttgatttgctcctgcagtcaatcaggcattcgctccttgcctaaatccgaactaatctattctgtaaacaatgatgta<br>gaacttgaattaatactatagaaacattaattcaatctatgcaggtgatgatgcaggtgatatatctacttgcataacctaaagaactaggcgatgggagtccgattgaca<br>acagtaccataataaaagggagatattctcatcctgtgcaggtgctgcattgtgtatagaaaatcattttgagaaaataggtctttttgacgataat<br>ttctttgcttatgtagaggatatagatctttcattcaggctcaaataaatggttatagaactaccttagacctaaatcaatctatcatta<br>tggaagtgctacaagcggaagcaggtataatgagttaagataaggcttgctcacgaaataatgtttgatgatttataagaattcccaattc<br>ctctaaagattgttaatttcatcttcatattcttggattttcataaatacctcttcttttaagaaaaggattcggttcaatctatttggc<br>ggagtaaagagggcttaagagaaagaaaagaataaaagaccccacttgaatgaaacttgaaaattacttaagatagaatggaagat<br>gattaagaacacatttgctactttaaaaaataag |
| Contig40_<br>gene_112_<br>6 | 975 | atgagaaatatagactatcaattattgttaattataacaaggaccatagattcttgtttagctgaactactca<br>ttatacatatgaaatattccttgtagacaacaaatcaacagatgacagccttgaaaaactcaagatactttaaaagtgaaacagaagaa<br>tattaaaaatcattccaaaccaatccaactggttttgcaaaggcaaataatattgcaatagacaagcaaaagggattcatacttcttta<br>aactcagacaccccttatgaagcaatccactatgacaagcctgcaagcgcagcttccaaatcctgcaaatcctcttttataaatgttctatataaatgtag<br>ggttccccttgccgatgaagtcttgacaaggcctgcaagcgcaagcgcagcttccaaatcctgcaaatcctcttttataaatgttctatataaatgtag<br>atagtgacaagaacgattataatctgatagcttgatgatgctttcttcatgtatgagcaagcagcgagcgaggataatctaaaagcactataacaaaagaataaaataatcaaagatattattatg<br>agtgtttacttcggccagcagatgtatgtctttttataaaagcactataacaaaagcactataaaaaagaaatactaaaaaagaaatcaaagatattattatg<br>agtttataggcaatgtatgtctttttataaaaatgccttcaggtcttga |
| Contig40_<br>gene_112_<br>7 | 976 | Atgattaagaaaatcagagaatattaaatgcaatactagtcatcatagacattattgtaattcttatctcactagcttgcatctttgtaag<br>attcaagaccaccatattctcagtaggagctccctccatccagtgactattccatattcaatcgtttgcataattcctactattctat<br>tatactacttctttggtcttcatttataaagccattccgtaaccaatcatcaatcatctctgtgctgaggacattgtaaagtctgacataagtcacattc<br>atcatcctggttgctatttgtcatatcagccaatcagccaacttttcaaggatcatgctctcttttaagctattggaattctatattcagcaatgacttgg<br>cgctgaaaggtgttggtcttgtattgagaatgatgagaacaaacaaaccttaacctgagcattgccgatttgccaggtgcttatcatcgagacaatgacttgg<br>cattcagttgcacataagattcaactctaaaactctattgggatacaatattgcctcgttcctcgttcctgtgagaaggcagacaatattccgacttactccgacttattataagttcaagaagatagtctcagat<br>gaagaaccaagtttatacgaaatcgtgatgactgcatgtgaggaagaggaatcaaggcagaaatcatccgagaatcaaggcatattacgattcttccgctaagc<br>ttattaccatctcaaacgaaatcgtgatgactgcatgtgaggaagaggaatcaaggcagaaatcatccgagaatcaaggcattaagtatcttccgctaagc<br>cttcagttgacatgctagctattataatcacatctccaatcatgatttaactgccttgcaattgctcaattaagattgagtctccaggaccttcatcatctt |

FIG. 8B-139

| | | |
|---|---|---|
| | | caagcaggaaggataggctataacgtaagccctcatgatgtataagttcagaagcatgaaggttcaggatg |
| Contig45_gene_62 | 977 | ttggagggatttatcttggttgaaatatcaattgtaattccagtctataatgttgaaaagtacttaaggaatgcttgatagcgctgcaatca<br>aacattcaaggatattgaaatatatgcataaatgtcgtcacagacagttccttagatatttaaagaatatcaagagtctgatgataaa<br>ttatcatattcaatcaggaaaatcaaggtcctgcgctgcccgtaatcttgaattaataaatctaaagcaatacgtatattcttgattct<br>gacgattatttgaactgcattgaaaagcttacaatatctgtgaggaaaagtcattggactttgtactttcaagctgcttaacttcaa<br>tgacaaactgaaaaaccttccaaacaaagtattataataaatgcttccaaatgataggagcttattacagatatcgattatccgaaggcatcatcttt<br>atgattgcgttttttaatttgcagtgtctccaccagctaagctatatataagagagagcttattacagatatcgattatccgaaggcatcatcttt<br>gaggtatgtatctcttttttaaagacccttctaaagcaaaaagaatctatttccttgatgagtttctatacaatcgccgcaggaggatgactc<br>ccttacaagctcaggatctgatgattattatgataaaagttcaaggagcttattatagattcctcaagtcaatgatgcatttgcagacctagatgattcgaactcc<br>tgaaggaagggattgtattataaaagttcaaggagcttatagattcctcaagtcaatgatgcatttgcagacctagatgattcgaactcc<br>agaaggaattgcctaaagcatataaggagtttcattatagaatcagactttatgtaagaaatcaaagagataaatgacttga<br>ttcttcagatgactataaggagtttcattatagaatcagactttatgtaagaaatcaaagagataaatgacttga |
| Contig45_gene_64 | 978 | atgaaaattacagttgcggttgtaggatatgtaggcttcacttgctgttctgctcgctcaaaaacatgatgttacagcttattacaacaacga<br>atcaaaggcagaaatgctaaatcagttcataagtccgcttcaggacgatgagatagaaagattcttaaggaggttcgtgaagagagaaccc<br>ttaatctccatacaacaactgataagctgccgctatcgataaggaccctaaggtaaatcctgatgtccttatgtcctatgtgtcataagtcaacataccgtagg<br>ttctttgacacctgctgttgaggacgtatcgagaagtatgaattagaaaacatcatcttcagccgggaattcttcgtgagtcaagctctcttatgacaacctcc<br>atatcagatctgtccgtgagaagtatgaattagaaaacatcatcttcagccgggaattcttcgtgagtcaagctctcttatgacaacctcc<br>atccaagcagaattgttgtagcctgtgatgacgacagatggaagagggtcagatgtttgcagatctacttcttgaaggcgctagaagagggag<br>aaaagagcaaactctcttgaacagacattccaatattgctaacaactaacagatgcttcaaagcgtttgcaaacacttaccttgc<br>tgtaagggttagctacttcaatgactgccttgacaatcagctagcctgaggatactgcttgcctaaggatacaaaacagctcttgcaaattatgacgagtgtgcatggacctc<br>gtatcgaggccattacaacaccaaccctcctcgatatggaagcagtgtcttcattctaattcagttagaaagaatttattgcaaatacaagattgtgaaagta<br>cctcaaacactgattgaagcagtctacttcaatgacagagtctttcattctaattcagttagaaagaatttattgcaaatacaagatgtgaaagta<br>ggtctatagactttacaatgaacagtaacagtgacaatttccgtgcatctgaatacaagatgtgatgaaagta |
| Contig45_gene_71 | 979 | atgcatgaatatgaattagtattataccaacatataattcttcaaaaacaattgaaagaacaattcattcaattttaacacaggattttaa<br>aaattatgagatgttttttgtagatgatgcataaatgatgatacagtagttgtatacaagaaaactttagcagataaaaggtaaattatcagc<br>ttattgtaaataaaaacataaagtcctgccattgcctaattcctattgcaattatgtcagtcagcatggaaagttctcttgttgatagcgat<br>gatctaattcaattcaatttaaccatattcctcattgcataattatgttaaatcagacaattttgattccgcctttacaaagaataaaataaaataa<br>tcaggatgagctttataagttaaagtgataaattgattgttgcttgcctgattcttggctgtaaaaggaattgttagagccaaagatttga<br>taaatcttgaattgcttatgaagacatttccattttgaaaattccattgatatttgatttgattgttattggcaatgtgtggcatgttgagctgccaatttgtataaaatactgtaattttatta<br>tcaagaggaggattctatttcaagacactgtaagcaatgtgtgtcaatgtctgtaaaactttttgaagtctgatctgtaatttataaatactactatttttaaggaagatg<br>attttgagagaaaagttggtcattcaagaatcccttagattaaatttttgcaatatgaattactttcctttcaaagtcccttaaaactttttgaagtctgatctgtaatctctacaatgtgatcaatgtgagatgtt |

FIG. 8B-140

| | | |
|---|---|---|
| | | tttaaaagatggatgttcttgatttatttaacaagttaagcagtttaaggtgttgaaaaagagattggaagttttatcttaagttagatt gttttattgaatcatagattgtattataaattgtgttaagttaaaataatcataa |
| Contig45_gene_72 | 980 | |
| Contig45_gene_73 | 981 | gtgaatgatttaaaaaagttatatgttttgctctgcaatttttaattgttattttatgtagtattaactttcatataatgttagacaccattaa tactttaactcatgttaatttagatttagtccaagcatgacaatgctaacgatgcaatctatattaaaatcggcagtagttcatttaccaaat taagcaaaatttttacctgtaa |
| Contig45_gene_74 | 982 | atgacaaaaattttagttactgccggtgcaggtttttatagtagtaacttttataaaatatgctgataagtatcctgattatgaaatagttaa tttagatgcttgacttactgtgaactcttgaaaatcttgaagatattgaagataatccgattattccttttgttaaggaaatatcatgatg aaggtcttgttgatgtgttgtaagcagcgtagactacatagtcaattttgcagctcaattcaaaaaattcctacaagtatccaccgacgagt tcatcaaatccaatataatcggaacacagtattgcttgatgcagcctataaatcaaaaattcaaaaattcctacaagtatccaccgacgagt atatggaagctaggcctgaaggatattcgaccttccaatcaacataacaagatgtcaaacaactatgccatccagttcaaggcagtgcagaccta tgtaagagcatatggagaaacattcgacctcactccaatcaacataacaagatgtgacggaaaaacataaggactgctacatgtctacgaccactg cctcatgatttctaacgcattggaagacaaggagcttctctatatacggtgacggagaaacataggtgccaacaacgaaaagcaaaacataagactaaac tcattctcaagaacttaacaacagaaccaaataacattttgaaacaggaatagtgaaacaatccactgtatctagacaatcaagactggatgga ataagaagaattaggcggcgaatatcaagatatttatgaaaagatgtactctaaaaaataa |
| Contig45_gene_75 | 983 | atgggcaagttaagattgttaaaagtgaagtgtatttacagttgaacctacgttttgaagatgaaagggctactttatgtgaaac ctacaatgagaatgactttaaggcagaggaaagctggtgtgattgattaaccttgttcaagacaatcaatcaaagtcatctaaggtgtcctagagtctcc atttccaatacacacagccacaaagcttggtctctgaagaaaatactctctgaagaaacaaaaacaactatttataccaaaagatttgccatgcttttagtattatcaga tatgaaatgggtaggggaaatacgcacagactcctacacaagaaatgcacagagatgatgaggaagatccaatgaacgatccagaaataggaatatggc cattgggaatcttaaggaagaagatataatttattctgaaaggacaaattatgggaagccgatgaaagagactccaactgattttga atgaaaggaatagttagctgaggtttcgtgaacaagactgtatccaattacaaacaagtgatacaagtattgctctttttccttttgcttgatgataagcc aatgattttattatccaatttctgttttaatgctgccgaattcatatgaagctcaaggatttgcctatgtataaggaaaa tttaggtgatggagagaatttaggaataagcttttcatatgaagacagataaataggaagccaatataggcgaaaaa ttattggtgatgataatgttgctcttatttaggagataatgttattcacggacatagtttagtgaaatactgaaaagagctatgaaccttga agaggtgcagttattttggtattacactcaaatccagaaagtttggcgtagttgattgattgatggatgtttatccgttgaag aaaacctaaaaatccaaaatccaaattaccttatattatcccaggactatattttatgatgcgtgattgaaatagctaaaaatgttaagccctca tttagggtgaaaagaaattaccttcgttaatgacgagtatcttaaaagaggaaaacttaaggtagaacttcttgtagaggcatggctggtt agataccggaactcatgacgcttgcttgaagcgcaaatttttatagaaactatccaaaaaagacaaagcgtttatgtagcatgtctcgaagaga tagcatttataaatgttatattctcgaattagccgaaccttttaaaaaaaactaattacgggcaatctaattctaatctcaaactg gcaaaatgaaaaataa |

FIG. 8B-141

| Contig45_gene_76 | 984 | atgaacagatttggaatgatttaatttatttatgaatttaccttatttattaaccagaagtaattgttgaaatcggttgtttaaaggagaaatac<br>aaaaacattttagaatattgctattatactaattcaaagttaaaagttatcgatccaaatcctgattcttcttttgacccatatctttaaaa<br>ataaatatggagataaattcgaatttttaaaggaattaagtttaaatggcttaattaatagaggattatgacgctgtccttattgatggagat<br>cataactggtatacagtttatgagcttaattaatgaaaaagatcgatcaaaataatttccgctaataatctttcatgatgtttcatg<br>gccatatgctagaagagaccttattattaatccagaacttattcctgaggaattccgcatcctataaaaattggctatgtttccagataaaa<br>atgaattgggagatattggttaaatccaacttttaataatgcagtttttgagaatactcctaaaaatggagtcttaacagccatagaagatttt<br>ttagatgaaactaattaaattttcatcattcctgtttaaatgcattctatgattgtgtttttgttcctagtcaatcatgtgatgaaaaaac<br>aatattgcaaattttttatgatgtgattgttataggcttttagagaaaacttattaaaattaagattttacacaggaacacattattaaaaata<br>agaatattgaaataaactaacaccaaaacagaaactagaataactcttttaaataaaaataaaactaacaaccaaataaactaatcttaattctaatttagaaaaagaa<br>ctagacaaactaacaacaccaaagcattagaaagctattagatactcaaagatgacaaacctacctagaacgaac<br>accaataccaagaattagaaagctattagatactcaaagatgacaaacctacctagaacgaac |
| --- | --- | --- |
| Contig45_gene_77 | 985 | atgacatataagtaagtatattattccagtataatgcagcagagtttattattaggatactttaaatctatagaaatcaaacatgga<br>ttttgaggatattgaagttatttagttaatgattgttcaacagataacacgcgaaagtaataatgatatgctaagaacatgagaatattg<br>ttccaataaatcttaaagaaaataacgtcaaccaggcattccaagaaacattgaattacctatgcaagcgcagactatcttatgttttagat<br>caggacgatacctttaaaagaatgcatgtgaaacattataacattaaacaagcgaaaatgtgatatggtatgtggtaaccacaatatcgt<br>aagcaatgaagatctaacatttgcttttaacttcgattggccgaagagatgaaaatcaataaagttgacgaaaaacccaaattcctaa<br>caatgggagttgcagcatggtctcaaaatattaagaaggaatttgtcttggataaataatttgaaatttaccgaaggagttgggaagatatattc<br>ttctcaatcagggcattgttactggcagatatctgatgaattctgtgagtttacttaactaaatttcttaattactgtgaaaaacataaaacgacaatttatacc<br>ccaagtcaatgcagatatctgatgaattctgtgagtttacttaactaaatttcttaattactgtgaaaaacataaaacgacaatttatacc<br>atcctttattcaatgcaggctgaacaatatcgcctatccatgcttttttgaagatactttctatagaatcttttttgatacattgataaagatgaatatcc<br>catgaattgttaagaaagtggctgagaaaccattcattaaagtaataggaaagaaaatttgacaaaggagtaaat<br>ttcgaaaatagcattaatatataagcgccattaaagtaataggaaagaaaatttgacaaaggagtaaat |
| Contig45_gene_78 | 986 | atgagtataaaaataaattcttattcttattcatcatctaattctgattttgaaaatttaaataattattataaaagttctaga<br>ggatattgaaaatgaggatttagagctttctgctatgatcgaaatttaaaatttacaatgactgtgaactttttagttctgaatattata<br>taacaaaccaaggtttagagcttcagaagtatatgctttggccatatgctaaatgaaggttataagcaaagcagaaatccaagccctgaattc<br>aataatgacaaatatccagattatatcctgatgttcgccttagccttaatcctttagcccattatgtgttatgaaaacagataaaggaaggcag<br>aagattgccttaagcaataagtgtccaaaggcaagaaagtcaatgtgttctgtaaaaattaatttatcaaaacagagtaaccgataatttagtct<br>tgcttagagataaagttgtccaaaggcaagaaagtcaatgtgttttcgtttttacctgcaatgatgtttgtatataaagacttataactatttt<br>gataacgatgatatgtttaatgttcaaatcgttttggttcccacagattaggaaacagttcgaaaaaatgaaaacagtcaaaagattacagatgttgcaaaagatggcatcgattagtctcaacttgca<br>tcaaattttcagctatctcaaagaaaacaatacaatgtaattgtaggatttcctaaaactatgaaaactcagtaatctccatccaacatattatgcatat<br>atccatatgggaatttgtagaagacaactagacgattatctttaattcggatgaattgcatggaaattgcatgaccga<br>agaatatctgattaattctactgaaaaatctattgtcgatcaagtaatgtagtcttagcaggttctgctagga |

FIG. 8B-142

| | | |
|---|---|---|
| Contig45_gene_79 | 987 | atggtgtagtaatgaaaaagaacaatttaataaaagataacttcgtcgctaattactttgactagcattaaggaaggttcaaatccaa ttcttattttaattatgataattacctaaaaaatatcctgatgtaaagaatctgaatttaaacactatctattgaatgaattg atgaagagcgcagtactaattttgatgaaatataaatcatcatacagttagttgaaaatccgattatttgattatactgtgaaaaa aacaatctgaaatattgattcctatagtcgttaaaggctaatgttgaaaaggatacaaccaagtataaaattaatgc agaagaatattatgaagttcgtcctgatgtaaagagtatcagctcgttaaaaattcaatttagttcattatttaaagtatgaagtaacctcaa tgactgaaaatttaaatcttaaagatgcaattttatcattatttgaaatagttataaaagatataaccctagcaataagttcaatggttcaatttgattta agaaacgaaaccggataattgaggaatctgctgaaccctttagtcttattatcaattttgaatatgcaaaagagagctactgataaatgtgataaaa acctgaagaatattcttagttagaatcaggatttattgcaaagagatacataaaccctagcaaacgaaatttgatgggaagaatactaaaagatatcctgaagt ggtaattcattattgaattggttaacaaaggatataaaccctagcaacgaaatttgatgggaagaatactaaaagatatcctgaagt taaaagcaggatttaatccttagttcattatttgaagtatgatgaatgaagaataggataaagaa |
| Contig45_gene_80 | 988 | atggaatttataaaatataaatctcaattcgaaaaaatgatagataataaattattggtatgccagaattaattgattccaatataagctttaa aagttaaaaataatatttttatgttgcaacaataattaaattagaaacatagatatttcaatgaaaatttctgtaattttttaggttcta atctaggcgtaaattctcattttaactatttttaataatttccacattttccttgaaaaatatactgcgatcttcaatttccgtt gctgaaaatcaaaatcttatcattggagataattgtattgttgaaagtgatgtaaaaattagaacttcagataattaccaatttataattatga aacagtaggattaaccattcaaatagcgtagtttctgccacctgagttcttattatttagggaatcctgaagaatattgaag ccgatcaataattagcccatagcccatagttttctgccacctagtttctgttctgttaaagctttctcaatctatatgtatatctattaggatcctgaagaatattgaag gaagatgtttacttgtagaaaaacattatctttagacaagattgataatatctaaagatatcttaaactcttaactcttgaagactcttattgattttttattcaaaattat ttttgtagaaaagaaacatacaaccgttctctattcgagtaa |
| Contig45_gene_81 | 989 | atgaaaagccaaaaacaaaagcgcaaaaagaatctagagagaaacctaatatctaaaagtgattgtgtagaaaatttatatgttt acattctggagttacaggagttacttctttaacaataacaaatagttgatgaaaatgtggaaaaggaatttgatgttttattattattgagtgctgaaa ataagttcttaaaattattttagcttcatgctgtctgcaaagatttccataatctcctgctaagcaacattatttgaaatattgttaattataacataga acagaaacaaataataattctcatgtctgcaaagattcatgctgtctgcaaagattcattctgtctgaaaatacatacctatttgttttatccctacatgact tattgtccatataagacattgattaaccacattattagatgaaatttataatcagaatgagagttaagttctcataataaaatgctattgtcct atgattcattaagcgatataaattccaaagatataaattttatttttgtaaaagatttattcatgactactctaatgaaatgactcaaagtttaagttattgaacatggcaggg aacttcctttttgtaaaattaaaacagatgtttgaaaatcctctcatcaaacaaactctataaaaatcttatgccagctaatcattaaacataatgaag ggttcgcaattgattaagaagaatcaaagaagaggaattccataaagaagaaaaatctgagattcatttaggaattgtcatgatgaattgaagaata tggttttctcacggcactttgaaacagttttcataaagtgaattaacctcattgttg |
| Contig45_gene_82 | 990 | Atgacaaaagtttcagtaattattccaatataaacgtgtaaatatcttaaggaatgtttgattccgtctgttgccaatcattaaaagatat tcaaattactgtgttaatgatgtcactgataactgttcaattttaatgtttcgatgaaaagaacaaacctatcaaaagacaaaaataataagca ctgaaacagagacaaggttcagcacgtaatactgcatttaaagagcccaaggaatatattagttttgttgatgcagatgattgattagt gaaaatgcttttagaaactgctctatattccatgcaaatcaaaagatttgatatgcttttttcaaatgattaattatatgacaattcaaaaaa ttatgttgaaactatcatataatcatctgtgttttgaaagaaatgcaattgatgaagatacaattttaattttaacgatataaaagaattt |

FIG. 8B-143

| | | |
|---|---|---|
| Contig45_gene_83 | 991 | tatttaaatataccagtttgtcctgtttctaaattatataaaaagaattttagattcaaatgatctttattcccagaaggcatgtttttgaa<br>gacaatgcctttttacaattctttatttaaatccaactgtcttgatttttaaaaagcatttatatattagaagacgccatgccgactccgt<br>tactcaaacatttgataaagaagtttgatattgttaaggcaacaataagtattagatgtgttgttttaaaatgaccaatatccaattta<br>aaaaggaactatattaatcatacgttctccatgctgttgaatgtttaacaaatttgaagatgattaaatgaatttatggttaattaaa<br>agagattttagagagattttaataattttaaagaagattttaagaacaatttgaaagagaatacttattaatattgatatttccgataagaacaa<br>atattattattattcttagaatataagctatcctcagcagattatgtatttcgataagaaagatatt |
| Contig45_gene_83 | | atgcactgattgagaaaaacgaactctttcttattggagaaatcgtaaaaaagaattttcagcaaaatataaagattcgatattaggatatt<br>ttgagtattttaaaaccattatatcatgatttttacaatcatatttcaaacttattttggcggaagcattgaaaaltatccagtttact<br>tttatccgaaaaatttatcttttgattttttaattctgctacatcagtatttcagaatttttaatttaatcttaataatatattaaaagaact<br>gctgcaccaaaacatatttttatatattagcaggagtcgtttcagaatttttcagaatttttaatttaatcttaataatatattgtgtcatgattgt<br>gaccagatcccattttatatatttggaatcaatgatagcaatcaattattgggatattatatattatatatatctctaataaacatactag<br>ctgttttatgttgtttactttcagacatacaacattttaaatccaatttttggtttataggccaattagaattcttgtgctatattccaatgaac<br>ataatcctgaaccgttcacggaatatgttaaatccaatttttggtttataggccaattagaattcttgtgctatattccaatgaac<br>aagtaggatgaatgttgaatttagttctttatcagtgattatttttagtgttttggaataatagttttcaagaaatttgagaaaagattactt<br>tgaaatttaa |
| Contig45_gene_84 | 992 | atgaatcaaaaaagagatgaattaaattctaaacaaaatataaacttggattcagaaaatgaatttcctcatcagaaattaatcttaagaaaag<br>agatcctcaaaatcaatcagatttaatagctcagcaacgcatgaaagctaaaaggaattaattgaaagatataatgtctgaaagtgaggctg<br>aaagtactctccaaagcataagaaataaggtaa |
| Contig45_gene_85 | 993 | atgcaaaagaaaataaaaaaataactaatgaaaaagagatagaaattcaaataagttagaatggatgataaaattgtcttttggagaa<br>tagcgctggtgtttcagaaaacaaggataaaaatgatgaagctataaaaaatgatgaagctataaaatgcagaggaatctgaggaaatta<br>ttccagagcatgttttagaagagcaaaatcctataaaatgccgaggatgaaatcgtaaaaaagaagagcttgtgattctgtttctgatgtggtgcctgttgtgggaga<br>gaagggaatcaaagcctattcaaaatgccgaggatgaaatcgtaaaaaagaagagcttgtgattctgtttctgatgtggtgcctgttgtgggaga<br>gaagaagaaaataatgaacctataataagaagaacgattcatgaagaagtagatgataatctataaaggtgaaaacatatggaaaaatttctcattattgtctt<br>catcaattgaagtaaaataatgtttcattaagtttaataattaaaatctataaaggtgaaaacatatggaaaaatttctcattattgtctt<br>accaaagagaaaagcacattgctaaatttgattataattctgaagaaacatatctactaaatgagcagttaggttatgataagaagttttagaatcaaaa<br>tagttgcaggtttgattataattctgaagaacttcaagatttttattgtgggtgcttggagtaggagatgtgaactttcaga<br>tttgatgaaattgtgaattttcgaacctgatattttgattattgaggtgcttggagtaggagatgtgaactttcaga<br>tatgcaacaattgtcgaacctgatattttgattattgaggtgcttggagtaggagatgtgaactttcaga |
| Contig45_gene_86 | 994 | atgaattataaaattagcattatcattccagtatcatgtagaaaatcattaaactcaattcacgtcaatagtat<br>tgagaacctagaggtcatattagtttgatgataactctacagatatagtgcaaatattataaaaaatatgttagcaaatatgataatttaaag<br>gaatactgtgacattggaagtgggttctgtgcagacctagaatattggttaagctactcagtatatatgtatttagattct<br>gatgattggtagaagaaacttgcctgtgaagtattataatcattaatgaaatgcagacattgtttgtgggtcaacaagactaga<br>caatgaggggcaatagaaattttattatcacttatggttactacagattagtcgttacagattagataaaatccaaatatttaggacatgcaaatgtcggggaaaatttt<br>aaatatagacgatccaattttaagttagtcgttacagattagataaaatccaaatatttaggacatgcaaatgtcggggaaaatttt<br>aaaaggacctaataacagaaaatgaactatcatttccaggagcatagttgctcaagattcagtttcgtttattaactcctttcgttgctga |

| | | |
|---|---|---|
| | | aaggatgttccacaggccctaattgaggcaatagtcaattcaaatgctgtgcgaaaggaattcatcgccgaccagattatttcaaataatccaaa<br>aacagttgcatatataggcttattatgaaaagcaacagcgataacttccgcgcatccgccatacaggatgtta |
| Contig45_<br>gene_94 | 998 | ttggctttagatttcagttgtaatggcagcttacaatagcggagcatatccaagactctagactcactaatcaatcaaagccttgactt<br>taaggaaaacatccaagttattatcgtaaatgatgcaagcagtgacaatacagagtcctgtatgccaagatctgatgcaatacatcaaaaactatcctaataaca<br>tcatactaatcaacaacagaatcaactgcggccctgccatacaagaaatgtggcctcattatgcagaagggagataatcaacttttttagac<br>agtgatgactacatatcaagcgtgagaccatccattaaactataaggcacagttcctttcttgaagacttgttcatgtgacatgcatcaatccaatcaagtt<br>tgtagggtccaagcgtgagacgtgagaccattcttcagaagcgacattcttaaagctagccttcaatcattccagtctcgctacgatgctcttctgatgctcctgtttac<br>cctctgcatcagcattcttcagaagcgacattcttcagaagctagccttcaatcattccagtctcgctacgatgtcttctaatcagatgctcct<br>aatgacaacagtcctgtcttcttggaatactctcaaactgcactctattttttatagaggaagcaactatccttgacctttatgaaagttccagaattcattcaa<br>tagaaaccctcttacttgtatcatccagagtaaatacatatggatcatggagataaggcagttggatcacctattggacctagaagaacctattaactccatcaagct<br>acaggtcttactttacatccagagtaaatacatatggatcatggagataaggcagttggatcacctattggacctagaagaacctactcactccttatgacaagct<br>tatgtggtaatgtgatccttcaatggaccaagtgatattcaatcaaagtccatccatctataaagtcac<br>aatctccattctatttctatattggagacaagtgatattcaatcaaagtccatccatctataaagtcac |
| Contig45_<br>gene_95 | 999 | ttgcgttatatcgcagatgagcttaaagtcgcaagactttcagatgcgaagcctcagatgcgaagccctatgaattgaattcattccaaaggatgagtttcattgtc<br>taatatgaagaaattagccaccctccagtacattttcaagtacattttcaagtacactgcttcttgcacttgcacttgcctcatgagattcaataagaagacaaagctca<br>ttcagctatgcatggaactgcattcgaatattcagaaattcggctatgaattcggctatgacatttgaggatgaacagaagaccatgcttaaagttctcaaacaag<br>atcaccaatcttatgtcagctcacacaatgtgattgaggaacatctgattgaggaacatctgattgaggaacatttgcaatagatgcagtttgaacagagtatcctaatcttaggatcc<br>tcgaaatgactattactctccagagacatctggatggaagaccctcaaactacaatagtttaattattttgacattgaaaagttcattgatgagctc<br>aaaagatagtcctatatgtctccacattaggaagaccctcaaactacaatagtttcagatagtgctaataggttgacttgacctgatgagctcactgacac<br>gggatgattatatattttaactttacagatataaggatgagcagaagctttcttaatctcaacattcttattacagagaggattctcatctcctctcgttatggttg<br>ttataacatagttaactttacagatataaggatgagcagaagctttcttaatctcaacattcttattacagagaggattctattcagatgaattcgattacagaaag<br>agtatactcttcttaataggccaatcattctctcttgcatatgactgcagaagcttgtttaggtgtaatcagacaagtgatatttgattatgtttgaggaataa<br>gaagttccgggcagaattgtaaagatacagatagcagcaagcgtatttcgattatgtttgaggaataa<br>gttcagttgattattttgatcatatagcagcaagcgtatttcgattatgtttgaggaataa |
| Contig47_<br>gene_70 | 1000 | Atgaagcttagtattatcatacctacatacaatgaagaggaatatctcctaacttgaaagcataagatctcaagagtttacagattatga<br>agtcattgttgcagatgcagcagcagcaatgataacaccagatagcgaagcttacgatgcattgtcgtagatggggcttcagcaatcg<br>gaagaataggggcgctgcagtgctaaaggagagatactgctattttagactctgacttgaattgacctgaacattatcttgaaaatgtcata<br>gaagaatttgaagaggaagatttgggaattgcaatcaccccagatgaccctctccaaagaaaaggacatctatctctcataacttagccaa<br>ttggtttatgatagctgtagaaaacatcaagccacatggtgcagatgctatgaatcatatccagaaagagctccacgacgaatgtggaggat<br>ttgatgaaaacctgacatttggagagaggaaggactttcaagatacagattatattgaaagatggctgaaagtagtcagttaaagtcctagaaatgctaaaatagga<br>gtttccacaagaggcttaggatatgaatttggacatgaatcaagctctcttaagcttaacatatgaaagcactgtaaatgatttaggggcaaaagaacaag<br>cgctgaagattcaaaactcaaaactcgaagctcttctcaaataccatctaaggcatgtgtgcggaatcagttcctgaaacttcttgaaaatagaacattgaaatc<br>aggaatcagttccaaaacttgaaagcagttgcagatataagtctcaaatagaaagataactcctccagtcttgaagatgaaataaagacattgaaagt |

FIG. 8B-146

| | | |
|---|---|---|
| | | gaccactatccaataactgctcttgacagcacagatatggagaggattgcagaaaagtccaaaaacagaaagcaaagttcatttaaagaagct<br>caatgagtttaaggacaaggaatttgaaaccaacgagcttatcgaatgaggatgaatcaggccatataaaac |
| Contig47_<br>gene_408 | 1001 | atggaaaacaacaagtaaaacaatttaaaatctgtggttatcatagctatatgcttattattgttttggtcttaggctcaatctgtaga<br>tattgagaggagttcctaatgatcatgatgtagacactaagtagacgaaaacggtctccttatttcagtgaaatggactcatactcctcaggtaggca<br>tgaccgagaattatatgatcatgatgatactttggtgactcgtctaatcatatgaataataaatatgttccaggatatgcattcatactttcctcttcttgaagtgcgtt<br>gtaggtgattatcaaccgatgattgcttatgtgactcgtgtaatcctactacaattcacaagaagattacaaacgactatgcgcaattcgcgctcat<br>ttgactggggctattgtttcctcactgctgtaattcacacacattgctatcatcagaagaatcatattctctcttatgcagttctttcctattcctttc<br>tgattgtagtattagtgaagctttaaaaactgataagctatacagaatcatatctctcttatagcagtagctcttctattttagaac<br>ctgttccttgttgaagcttttattatgttgctgtaatggctatgttatgattgttgtattatgcttctattgtcttgtcacattaattgtattgtgtaggtctaattgatta<br>atgacaggttatatgttgaaaataaactgaatggctgaattattgaaggtgaattattgaaggtattaccggcctttacaggagggttcaccctcaagcaggtgctgacgtatgcctaa<br>cattaagaactatgaaatataaactgaatggctgaattattgaaggtgaattattgcaaggtattaccggcctttacaggagggttcaccctcaagcaggtgctgacgtatgcctaa<br>ttattagccgttggagtaggtgcgaaatgcaaattcctaattcctaagtactgtaggtactgtgaggacttgtaggttcattcctcgcta<br>cgtacttatttccgttgcgaaatgcaaattcctaattcctaagtactgtaggtactgtgaggacttgtaggttcattcctcgcta |
| Contig49_<br>gene_169 | 1002 | atgtcaagtttaattcaattcctactttgccttaattgttatcgcattgatatgtggattctttcattataagtactcgtttgttatgcc<br>ttggcttattggtaagcttgagcaggcggaaattattggaaagacattcataagtcctccgtcccgttgatcctgtagctgaatgggtggtattggta<br>taatattcggattcatcataggatctttgccggaataattctcttcaaaggagaagctattcctctctcttttgcaggcataccattatgtgggt<br>gttggaatcatcgcatgttgatgaccttctatatatgatcatgatgaccttcacacaaagctgtatcatcactttgaaagtatgacgttgcgattataagcatgaca<br>tgcccctcctaatcaggccttgggttattcaatgaccttcacttcacaagtacgaataagctgtatcatcactcttgaaagtatgacgttgcgattataagcatgaca<br>gaatagatcaggcctttcttgcattcgttcttgaaaggtaaagctcacacatccggccaagttcttctaccgaacattataagacttgtaaggccgtataccgtaccggtaccctatcattgggcgacaat<br>atgctggaaccctctcttgcattcgttcttgaagggtaaagctcacacatccggccaagttcttctaccgaacattataagacttgtaaggccgtataccgtaccgtaccctatcattgggcgacaat<br>cgctgcaattgcgttgttattgaaaggcagcagcaatccgactcagcttcattgctgtgatgagcagcttgatgatggagcagcattatatagacgagcaggagatccctataagcagctt<br>gagttatgaaaggccggtgatgaaagactgctgtgatgatgagcagcttgatgatggagcagcattatttttggtatctcgtataaggattcttggtataattgttgcactgctg<br>gtattgaaaggccggtgatgaaagactgctgtgatgatgagcagcttgatgatggagcagcattatttttggtatctcgtataaggattcttggtataattgttgcactgct |

FIG. 8C-147

ORFs encoding the biosynthesis of exopolysaccharides identified from *M. ruminantium*: Amino acid sequences.

| ORF | SEQ ID No. | Amino acid sequences |
|---|---|---|
| Contig40_gene_55 | 261 | msneisqntegiflvvpayneertvsqiieciaergynvvlvndgsadstlelateskrkypdkifvvshvinrglgaalktgmmvalnkga kyiitfdadgqheisdipnvckplqdgeadavigsrpfedmplsksfanlvmnaltfifygrnvkdsqsglraftaeaaekidvvstgygvs sefikeisdknlrlaevtittiytpetqhkgtdaivglkilgkmvidlfri |
| Contig40_gene_106 | 262 | mlrgrnmgmknlilsksdqfnhykdkanqlkkenkelklkneelefknnelspeleegisliipsykgenhiqplleslekqtiskdlfevi fivngemdstidiltdfaksnpdmniiisytseggvsnarnigiriakreyigfldddfisdnylkalydhiapnrvvlsnfididdeetge eigsrlvpysmnregifndvvvkltnlsiittakiipalavkgtdfnpnlnngvdvsyyarlypknhfefyfvskeegavyyrirrsgsisr qetsyqfnvldrlkviddinesykqvdksdelyvhflkilfdaqtyfiglyldeypqdrekvieevrkhnfeyfsyekleg |
| Contig40_gene_223 | 263 | mkilvvqesdwlkrnphqqhhlmdrmvlrghevkvidypidwpkedskgllifhrevhenvskvkpeadievirpsfikepglnyaslyfthk keikkqidefkpdiimslgllnaytgsklakqhgipfvyylidvlyalipekafqsfgkkvnmkaiensdlvitingklkelamelgskpet tilidagidlndfdpqlddsnirnmynisedtvlffmgwiyefagmkelamelgknkekyphmkilivgdgdaydrmveikeeydlgdqli ltgkqpyeripeflasadfcllpayideeimqdivpiklyeylamekvviaselpgiskefgygngieyvqkaeevletaqrildegryeei skkgreyvksndweaitdkfenaleelik |
| Contig40_gene_233 | 264 | mskyneyqdktilvtggagcvgsnltrklaelgaekviildnmssayewnvptnenveliggdildeelkrvfkmkpdyvfhlaahfanqn svdnpetdlmvngigilkvlqyaqltgverfvysssgcgvygldskmpfeehdisislhtpyqvtkllgelytnyfhnlydmpivnarffnv fgpgevpgkyrnvipnffywsmtkqalpitgdgtetrdwtfvgdivngllsmgveeeaigeainlgsqkdhrvidmankvnqltgneegiay varrnwdaktkllssidkakdilgykptvsfddglervygwftdnwedierdaef |
| Contig40_gene_257 | 265 | mkdknvvtgglgfigshivdaliddnkvtliidnlssgkmeninnpnhenitiikedlmdadlekilkdkdyvfhlaalasvpgsvaeplry nqnnidaslkifiacknnnikkvifssssavygenpnmplkesenflpcspyaaqkascelylksfhesygldyvalryfnvfgprqdensp yaavipkfisailngespviygdgeqsrdfiyvkeiakanilsaesdyngvinvalgksmtinrlfeiisdvlesdidvkylderpgdikhs ladisnldkisfkpdedkfeeqlretvkwfisqme |
| Contig40_gene_303 | 266 | masivaiipayneealadviaktskyvdrviivndgsadrtadvaieagaelinhptnlgkgealksgfeaitddsiivtidgdgqhnpde ipiilkpiiedgvdlvngsrylygheentpayrrvgqrvldiatnisagikvtdsqsgfrafspkarncfrfkdtgfgiesemlvdaaeagl kivevpitvrydvdgstkdpvthgvgvllkimkdkavrtfkk |
| Contig40_gene_304 | 267 | metqrimvtggsgfigtnlvnelrsrghevlsvdllhhedeadlysdsydyvrgdirnyrqmerifddndkfdyvynlaaeygrwngegyy enlwetnviglknmirlqeklgfrmisfssaevygdyegimsedvmenrpikdtyqmndyaiskwagelmcmnsatmfgtetvrvrpvncyg pheayspykgfipifiykalhglpysvhkghkriidyvedtantfanivdnfipgevynvgskqewemtieeysdlvleavgiddslvtytp aedfttkvktidfskairdlkhdpkvspkegikrtvewmkwyyried |
| Contig40_gene_305 | 268 | mtnkspeeieelkaqlskyrkenrilkercasyedriehfaierkelsraitqfeslelelrqydleeliqntrklnhridilrrylqter edneklnelinkltkelddanyeisrlttefhklrvrknqrtyflenrldiaytklaqlkytlnefeelgfwdrlrgkkpesyddidi |
| Contig40_gene_306 | 269 | mkavipaaglgtrflpatkaqpkemlpvydkptiqyvieesvnsgvddilivtgkgkrsiedhfdrsfelehhlktkgkedflkeieyisdl adihfirqkkqkgigdaiycakkhvgndpfvvmlgdtitkdtvpctkqllidiyekyeksvialeevpdekveryglggeeiedsiykidkl vekpplrvapsnlaimgryvltpdifdcienvepgyggeiqltdalskldeiygqvfkgesydignridwlktslrfaleddsarddilefi keeli |

FIG. 8C-148

| | | |
|---|---|---|
| Contig40_gene_315 | 270 | militggagyigshinkllnksgyetivldnlskghkkavkwgslvnadisdsdklreifqnndieavmhfaafssvaesveepekyfknnf entanllrimkefrvrkfifsstaalygipkeipisesaelkpinpygesklmvenllkdesdfgglkyvslryfnaagadldceigedhnp eshliplvldaaigrrnsisifgddydtpdgtcirdyihvqdladahlkalqyleepfndsnifnlgngngfsvkevidtckkvtgidfevk vegrrpgdpdiliadskkaeevlkwkpeypdledivesawnwhkklhg |
| Contig40_gene_366 | 271 | mtvsflfvngaasvllnaidkekavtkiyimavifnvclnlvlipmfsydgeaistvlsvkyllsf |
| Contig40_gene_367 | 272 | miiiplsigiffyarlidfiysnqyslastliqiiv |
| Contig40_gene_368 | 273 | mnqiksifkntgwlsvsqvitsicaflwtiiiarylgvsdygivsfavsftglmgivmdlgistyitreiakhkdlvrkyfnnifflfklila iilfilsglilymgyshltiivtlvftielifmsmttflngvfqafekvkyqaigailnssflligilitlgfdlgvisiafaytvaysiy fsymflsyvktfsrphledtnfireviiksipfgltnffysiyfsididvmlsylagdyatglyksayniinvfttffvvygsvifpvmskf fkesqnllkvsyelvskyllllipsigiffyarpvvdliysnqyslastpvqiliwtvsflfvngaavllnaidkektvtkiyiiaaif nvclnliliprfsydgaaiatvlseilititilyhifktdykpdlgllknvilkivcgiilfvalylnlslwfaipvgfivylislfitks iddndryvirelinr |
| Contig40_gene_369 | 274 | mlmsiicvyndeevlekylleslktqneeyellildnrnhefnsaasalnyggkkakgeillfvhqdvefyennlkdikyyfencqnlgiag vqgvseenygrittnivsgipkstvsdysitditetqtldelllliipkevfgkyqfdeetcydwhlygadyclnikqkgysvvlfpitlyhv seggsmsleyfktlkkvlnkykydynriytncllshepnnqlkldilyyseilhirnpitnflsnfnflkkilk |
| Contig40_gene_370 | 275 | mqtvgmilcggfgkrlrpvtekvpkplveikedyaildkqlfdfknaginevyllagflhekiqerygdeykgikinyviedeplgtlnair lgmealgedkqvvirngdivadinlkkmieygersdyfvtmfvtkmtspygivdisgdkitafkekplldyyinggiyftkglldfgefktg diektlfpvlakenklgyyreddlfwmaidtskelesvqkeyenktdkpwgyekvliytdkyltkelylkegfqtsfhyhndkdetmyimsg agyiefedrkeyfgkndsirikpgvvhsiiatenttlhevstpfldtirvkdytr |
| Contig40_gene_371 | 276 | msekkkikvkfvdfqdslkendnffidslkknfdvevsddpdylffgaygykhldydcirimwtienyvpdfnicdyalaydiiefgdrylr fpfflnrpeienvrktierkpidtsvktdfcsfvvsnewgddyrirlfhelskykkvdsggrslnniggpigmgldkkfefdvthkfsfale naqnrgyttekifdafaagcipiywgdpnieeefnpksfincndltveeavekikevdqndelyhamlneptflgldkylqdfddflfnic ngplekayrrdrimkgtgehqyklinrfyykpyfflikvaqklhiefigrkiyhfird |
| Contig40_gene_372 | 277 | mssqniqiyvvshseediknidsndiytplfvgragkdnlgfvsddtgdnisnknssyceltglywmwknspadiglvhyryrfyfanwrlgk rlerediekifseydiilpkkttallgsvyedydhwnyakdldlceevigeqcpeyldsykrvvegkdlyynmfiapkeviapycdwvfpi laevekrvdmtgyddyqkriygflterlfdvwmdkqnlrvkecelkvnglrlnvhmwivkrkivrwayvhiymglhkdmrr |
| Contig40_gene_373 | 278 | mpcnrkreshignvyteekhninvhkygahifhtnnkevwnyinqfaefnrytnspvanykgelynlpfnmntfyqmwgvktpeeakakik qqkaeanidepqnleeqaisligrdiyeklvkgytekqwgrdctlpsfiikrlpvrftfdnnyfndlyqgipmggytkliekmldgidvel ntdfledkdkwmamadrvlftgmideyydycfgeleyrgldfefetldmenyqgnavinytdretpytriiehkhfenavsdktvitreypk awekgeayypmndernteflfnryndladkegnvifggrlgmyryfdmwqvideaklvksle |
| Contig40_gene_391 | 279 | mrlevvdksvtkninfrlvydsikayrlsselcdnfniknkdlflnpyllnwislwlsrkntkeenkifleefdkldtkkygkykyklilkt tklllkiks |

FIG. 8C-149

| | | |
|---|---|---|
| Contig40_gene_450 | 280 | mkiamvgfpphiggvgvhihslakqliregheyvityphkdikdidgihvigtkginipglrglmfginakkelkklineenidiihghy lfpagwasvkagkstntktyvtahgsdifemykkqkfmrpfikkvlsdadivlavsnalkdeiikidvpgikekikihwnsvdiekyktee nkdkfkkelvneynldpnkpmilfvgniikrknvnllveakrliktdanlvivgegselgklkekvknddkindvyftgarrdvediypscd llvlpsfsesfglvliealacgnavigsniggikeiitedvgllinpndsqdlanaidkilqdeellnkfksnarnrakdfsktelpydelk |
| Contig40_gene_470 | 281 | mkiaivlgtrpelikmasvmdeienrghellihtgqhydkemsenffidlklptpnynihvgsshgaqtgkmnegieevlidekpdiilv qgdtnaviagalvaskilhipvghveaglrsfdetmpeeinrlaadicsklyfvpteesainlamegisrkrifitgntvvdacfrnleisks rdkdqydegilqeldidnmdniltltmhraetvddkerltniieale elsdmniifpihprtkktmenfnlfdrlndlphvhiikpvgyldfl lliskstilltdsgylqeeaitldvpaltlrynterpetvtaggnilvgsdkevilenarkilddedfanrmksaknpygmgnaaelmikii eesdkndtlkmvapdevmasftrhmkavdeditvvdfeeknnslikiafqgedikypydelnlngltiiyedys |
| Contig40_gene_653 | 282 | mykdnkilvvipargskgiprknrirflgkkpliahtiemgkaskyvdelvttddeeikfisekfgaetikrdgklaedsipldpviydaa iqkegksnekydvitvqptspliktktldlaieklinpdnenkdydtiisvvddrhlswgydekekyfplykervnrqyIpkayketgsi fatrrefvkedsrlgenigilevskqesididnyedwwvaerilnkkkilikadasheigtghiyrglsiasklvnhevifildeaqelgie ivknnypfithnsnkgkgkeadekakeeliekiveydpdiiindilntnskytktlrdngffivnfedvggvkyahlvfdalyehkiplk nlysghryyilkdefyyqsfkkidkevnrilltfggtdpnnltektleailekyqneieililgyskkeeiqekykdnerisiyenvkrm sehmhnadliftsagrtmyeiaslgvpciclcqnerelshifgniehgfinilgsrvskedlirtlentindyelriemkrmgnvdlkhg fdnirklikkeyknwkaeqlnk |
| Contig40_gene_654 | 283 | meskditnieeiipsndvyplvnllfqsklfkskeintnslaiscldlidknrikitfneeiesikisknplitkgqlekelelmkniqkt inskemkldkrdqiilkmfkdinknhefdlksmydkilkqdiaikfakyfkdysksleretkysleltkiknpklkdgef tfkgreisnewkef ksslksdkslysqdaeiidkyliygrcleiekdvlkniekanpdydselyrflrhngadllklifdkalanskierkgdgsvpvgnskyfvp gfg |
| Contig40_gene_655 | 284 | mtifneepfliaeigvnyydiakkenisnmdaaklmvkeahdagcnavkfqsykantiasknspaywdtneeptqsqyelfkkfdsfgeaey reiadyckeigilflstpfdfdsidyldddfmdvykisssdltnipfikkiankgkdiiistgastldevklaietienandkykgeagigi mhcvlsyptanedanllmiknikdlypnyeigysdhtkpdenmlilttaylygatilekhytldktlqgndhyhgmdpddirkfnkniellik tingqydkiplpcegesrkqarrsilakeeigegtliitedmltykrpgtgispseidnvvgkkakitipedeliqydfle |
| Contig40_gene_656 | 285 | mtftvkeicqhiwsleekyelnhkeigqcypwqlirmylyyeitrktnvfesaqqsslsladkvntflpfiknsilsnplsgkdtkdvlifd hprkvilngeyqdiysyflkdiliknnksfetiespylnnhfrssankennvkyndrillgsfinktknrglkplpftdeekdfietikrele safkieinlfniiedhilnfqydykkyiellekrkpkqvylvvayenkalvaackkknieieielqhgtispyhlgysypkntmlmntikei eyfpdkilsfgdywqnsssfpiesdkiismgfpyfednsktfmkmadedknkkqilfisqgvigkylselayelakelneknkndlensen nesdlennytfiyklhpgeygtwrenyeylnkanefdnfkvidksepplyelfaksnyqigafstaiyeglafncktfiidvpgveylddl idknivkkvksseelinfiededlndldlkeydkdyffknfdesifdeil |
| Contig40_gene_657 | 286 | mwaqvnttialvpnianlglpytmvrflsaekdkekirdsfypmisltfistviiclflifghpiadalfngsmqvlyittaisffacmnl mlityfrtfqemkryslflvlqsyigvfvsiylytagynietvvlgilitgyaavfimmaflivrhlgfsfgkwsnlkeqlafalptipsnvs swvdssdkyvigillgsvavgcyspgyalgsillmflspfavllptilpehyekgdmaevdkylsysmkyylllltvpaavgmsvlskplly iittpeialggymvtpfvclgaifmgmygitnnlilileknmilgklwilvvaisnivlnlilvpylniigaaiatllcymlafgvtaiasrk tmrlpfnrkelvkiliasaimgavvymnmnpsgivnvlvailvgvvvyfaiifvlkavtrkeigifkdlvk |

FIG. 8C-150

| | | |
|---|---|---|
| Contig40_gene_660 | 287 | mnilhvahffypclsaggvvnasyqialnqvkdnnvhvytsdsckqrlkfedgrydvdvdgikvdyfrnlsnrfklatmldtplsayfrirk diknhdiihihehrqtlailvshyarknnipyivqahgsvlpffqkegiknifdkafgfkilhnascvfaltevekeqyikmgvsedkieiv plginieeyenlpepgkfrsrfniadgdklilfvgriheikgldllidafnllikdssspiklaivgpddgyldtlneriaennlesqviit gplykrekhealvdcdlfvmpskyesfttsgleamacgkplvltknnhihdwvdgnvgiscdddeislkeamkklifdddlsetfssngkkl ikekynwdmineqilsiynrfi |
| Contig40_gene_908 | 288 | makkvliivtgrglggdagialnvynaltkrgmeceialdesapgilfkknnmewnkviipqagghsatlkttvnaatrsvkalfktrslik ekkfdlvlgilgggaiigalaakitrtpsvsllitpldtkicgkigtpllpennilflepnipdrmvksflpvndnislgdkkkaldklneh cselkkknpdamefdpskqtivfssgsslfektaqaidqfskysdrfnlvlcgdpleeefykyidetkiinvgfidwvndllhladlavltn dglmleamvcnlpvvilkrvkygryhdmvsifkgatiecdledldeaifdvvdnyddyakntatykeailsvgdniadiveksfk |
| Contig40_gene_920 | 289 | mseesssskvakgsaililignvifrvggyilyrflmasilgpaaygilgilttpfqgifqvlsaaglppaiakyvseynaldekdlarqtifts lkimvflglffgflimvfvaapiiltnyyhkpeallplqavglitpfsvivggfrgafqgvykmeyilytraieqifmilmatalvllgistlg avlgsvlgfvasaisavyifkrymgkyippanpdfkfplkdelklaktliffsipvtvaalaemgiysictllmgaflpaaaigyftaadpi arlplvvsnslattilpatseayalkdqvllekyvtapykygmffvipmcvgiaifargimglvyftnaaymngavslailvvgmtfysvyt isgsivqgignpripmyiliigcvitlglgwyliplpfgieggalattissfimmvpmfliqfrmtkthapysflikvtvaslimaivsiivp nnvyglitgivvcpivyvimvillktlshedvaefrkyanklgpirkyankildfidkhssd |
| Contig40_gene_960 | 290 | mvipafneeatvagvtvarklsyisevivvddgstdktveeaeragatvishkgnqgkvaiktgfknshgdivafidadvsnftptkidk iikpilegktditktkfaresgrvteltakpllsfffpelnyeqplsggfagkrsalnkifekdygvdvgivldadvhgislevdigdiq hdmssladlnkmanevvrtiidravdygrvtmmdtlgnyirmaimglsliiiglfmiffvpfiplvisvlvalvgialtiayiikivqrsip ilrkgdtstalksfvkmhfpvivsglililmlstflsaatfndgrisveltsrnfvyspsddyhqtisvrgpytidsaienetdmvrippda lstlemsandtmiidgeyysvntsregevdvfrlskavrhdldlyprevipnsrlaevfngvivnhninfnnssevmegyvqfsispkatna tffnltldneslsvgnfkndsyytiaydddilcaftgddikkgnvtfeyagkdgmivfedrnntsirnfidsdrdsfvklyt1 |
| Contig40_gene_967 | 291 | mktrisviipiynvhefledciesvlaqtinhwdlvddyqrnlqiilvddgstddsgeiaksyaakyenveyryeengglgharnygcefae gdyiifidsddiippkayermyrialkndsdltigsvwrfnskltwasniheiafggtkelthikespelfydttawnlikfsfwkehgfq fpegilyedipvtmpmhylannvsivyencylwrvrdgisksitqttddlknvedrlyvmglvdkffnenvkeeelhrvknlkwiknldlmif inklksmdidesqeiidlldyidrnidpkyfdeineieklkyeylferdfdrlklnyehvnfytlnihskgsdvviegdkdvfktssfi vndfikegkkakyiqkvnleeealevsgfvvipgleakefkdveysfylvnsenrkkialrheqiylgninsyrlrfgkkfsykaagytvfv pyeliednedflgenkiivvfkqrgvthnifagnakknvrsrenravligktymsigydknneiiinvskarhsydrieledddlcifgpy dgdvflhynksfispesnipfayddgnqcyrldlnirstegqilydngeslvykdkellclysskgqcvissldhnikinkfknfslvse isernneidivsrlhsldlgdrqlksatlyfldknqssypiaeakiikdvsttqdshigdnayiddkdsedidsssingentyelnfknm nnkiitenlyhgyfdllirydfgdlvfstpihlldfkalikkkvfhftiyrgnawtlrirakkwnwdgrpriytrayrifkhlpinkkr imfesmwgakyscnprylyeyidenhpdyeciwslndehipingngirvrrwtlkyfyylatskyfvdnvnfneryekrepqryvqtmhgtp lktlgldvpgdfptkaseerfiercsrwdyitvqseyvediarscfkfdkdflrygyprtsmlytmnneedinkikermnipldkkvilyap twrkknkveim1 |

FIG. 8C-151

| | | |
|---|---|---|
| Contig40_gene_969 | 292 | miipiynvyefleeclesvvnqtindmeltdgyernlqiiliddgstdssspiiakeyaqnyenieyhhevnqglgharnygcefaegdyiif<br>ldsddklspnayewmyktairndsdmtiggfwrfnskkykisninkiafngnkekthisespelfydttawnklikhsfwkkhnfqfpegil<br>yedipvtipmhflannvsivyencylwriregksksitqttteiknledrlyvmglvdkffdenvdderlrhvktmkwlktdlllifirklrs<br>mdkeqgykimslirdyiqnnidadefkylneyerlkyeylmddeidkivsilnfkaeniketkvyqknghimfnadkevfkqspfyidqyir<br>erynrkyigdieirddgflirgfmlipgldiknfkdrehrfhltnanshkkikidsedvetgnissfnirfgrgfsydaagykifipfskic<br>daedffgenrisvdfklngiyqspflsyekkelcqnflgyakkdirqktnmkaviykntyflirytlkdeiliiealplknyfkeirldenv<br>lkldsdhignlyiyyeadsineeekiafeydnedksyqidirklkkkpgkilcdgensiykskelilldskyqclistlndyyldiyyfds<br>ltqvldirqnrdrididaklysnrfnetrstykadriktaklyfkddsskenyilsdgmidrqtgdikfsidfsnkeitknlyekihdlyve<br>yaydetsteeeaivnkevdeseydsvskeekennkiektenepvpegrnnkineesrfstelylfkgddktisksyyekvyhdlkgflkl<br>kvlkrwpvyedtpgkrlkhsqisyklfskłpinkkrimfesiwggkyscnprylyeyidenyphyeciwsfkdehypikgngkcvrsslky<br>lyylatskylinnvnfkkhfikrkgqveigtmhgtplktigldapgefptkksqkdyikknknwdyltvqsdyvaeisrtcfkyekdflkfg<br>yprtdilytknn |
| Contig40_gene_970 | 293 | mqdpkisviipiynteedyieetllsvinqtifdeieviivddestdnskyliekyaldysniqvfhqkneqgisrnyglskskgeyihfld<br>sddylpptayetlynmalknesdivignvlrfalynvweeslyknayndfdediaimslnerpsilwdtlvtnklfnreflirknirfpnkk<br>isfqdipfslesyiladsisfskeifhywrlrsnqssvtqqdkslknikarleilrivqnllekyeveeeirnyeyskwlnhdlkfflkrfn<br>yypkeheelfeevygikvkiipdalidslnsykkvlftmirnkdyenfllfaplenelyknpeipsflndeyksyfdfekameeeelniell<br>dfkndndnlyidfdgylnylspndnykkiiaklvdendyenpllvnhlenkqiaipfyllkdkraqikviyefesfkktaylknrhrksier<br>ekfidldlgknsylyldireknienyidididisfnskeftikakskksidkismeniisfekiaypiydlkyeenednnlkneengeytfk<br>fkipydilksavkkwelncdeyfnsiklsetfeffetykikfvntrnkilieneifnpikmiyalnhentdlklniktlkgensrlnkei<br>kktnekneilneenklidknktlnkenkklnkkieeyksrkvvkivdslkn |
| Contig40_gene_977 | 294 | migvilaagmgtrlmpltkdipkallkinettllermikncinadiskfivvgynkdkvidlcpeiaekydieiktienekydvtntsvst<br>ylaskfieendlddfilvngdnvvdpeiitrlavsqntgmiidnfkelneesfkliiddesfnedktiangkinsigkgldipsstgefigv<br>skvvsddvaqfnrilekliieedpqnyydfaykdlsliktidfvltnglkmdrnr |
| Contig40_gene_978 | 295 | maeekrsfkklikdilyisakrsaralyyigsyiipanekiilfessngrnytgnpkyiyeeivsggldkeycvwsfmhpdkkipgnaiqa<br>krsffkflyytlrsgtwifdsrhlyylknnkktkyiqtwhgtplkklalomdyidmsgnqdieayheefrkntsawqylisqneyssnifrr<br>afdfkgemleigyprndilvnkdnekdideiktrlnipkdkiilyaptwrdngfytkgqykfatemdfdrlyeefsddyaliikfhylvke<br>nmdwskyndfiiecdadwdigelylisdmmitdyssvmfdysilkrpmiffaydlddyknnlrdfyfdmvedvppicqtneelvdfiknys<br>enayknt figekyewndkfngfddgkasqkiinlliker |
| Contig40_gene_111 3 | 296 | msinksknslsknklkslfsgnsnksryqsklirgdfdslhdlniayvlkgfptlsqtfvsnelrylvedgfnvvfvcymdpadlveldfd<br>levirfdesddptgkleqlldyeidivhthfvvppcteytfpvcdrigipftvfahavdifkydvkinrvdeiskspfckgiltlsnyhk<br>nhliergdkdkihitrqatdyeieielelkernvrnivsisrfvekkgidvlidvadilrdedyefsiygfgglekayrqidelnldnisi<br>kgrldgpqevkevfdkadilaspcriaengdrdgiptvifeamaygvcvlttevsaipeviddgrngfivppdspeifadkireianlspee<br>rfeiakqagvdvqdtssvdetmktlfltwsl |
| Contig40_gene_111 5 | 297 | mtkpkvsmilsayneerfidkaicsltnqslkdieiliiindgstdktpeliekyaeedpritvinqsniglgasrnkgmaiaqgeyvgfldg<br>ddwyrldaleiayneaksdktditmyqminyddatgriyendwfnlnnldesfdgiviftpektkdfifdclsvsscqkiyrndflksinasfp<br>egiyfedmpffyvylkaerisiirhffyyrrkhnasithvvdanyldtveagcelmrrfidngfyddykfdliaykingprmalmditeda |

FIG. 8C-152

| | | |
|---|---|---|
| | | keplfnlikedyekikntemeeyqdyldnlgpkkkkfldvikydnyeefkknnpey |
| Contig40_gene_112_0 | 298 | mkicivgqyiglptaalfaksgcevvgvdinkeiieklnggiahieepgisdsiknavdqghyhasltpeeadtfiiitvptpylpedlscd lsyvisacnsilpvlkkgnvviiestiapmstdevikpifenegyvigedlylahcpervlpgqimeelvnnnrivggiteectkkaadvyr tfvkgeiieteaktaelskcmentfrdvnialanelakicaeigvnaldviemankhprvnihspgpgvgghclaidpfyiyakapetakii klardtnnsmpgfvientgkilskldkdaekisvfgvaykgntddarespafeiiaglkaagyevvihdphfdnpdyldfddaikdssmili lsdhnqfkdmdydsikrnmktklifdtkniiksvpedvtlvnygnlykfih |
| Contig40_gene_112_1 | 299 | mrilitgaygmlgsdlrevlknhdliatgskdlditdeercidfiakerpeivinaaaytavddcethyddayavnalgprnlaiacnkidi plvhistdyvfdgtkrtpliendklgpqsaygktklageefiqentqkyfilirtawlygihgnfvktmldlakehdeitvvndqigsptfs ldlamaicevldsdkygiyhltndgecswydfakeifrisdidvkvipvsteefprpaprphysvlsnvkwksagfvpmrdykealnqyisl ynffvkigki |
| Contig40_gene_112_2 | 300 | mkgivlaggsgtrlypitkavskqllplydkpmiyypisvlmlanikdililistprdlpmykdllgdgsnlgmsfsyaeqenpnglaeafii gedfigddnvalilgdnifhghrfteilerardlddgavifgyftnkpeafgvvefdnewnvlsieekpehpksnyvvpglyfydndvieia ksvkpsdrgeleitsvneeylnrgklkvellgrcmawldtgthdglleaanfietvqkrqslyiacleeiayskgyiskeellklaeplkkt aygdyltklaerki |
| Contig40_gene_112_3 | 301 | mgkfniikseiegvftveptvfedergyfmetynendfkaegidltfvqdnqsksskgvlrglhfqytqpgqklvrvikgevfdvgvdlrkd sptygkwmgeilseenkkqlfipkgfahgflvlsdeaefvykctdfykgddeggiqwndpdigiewplgdlkeedlilsekdkllkpmkdtp tdfymede |
| Contig40_gene_112_4 | 302 | mtkilvtgagfigsnfikymldkypdyeivnldaltycgnlenlediednpnysfvkgnimdeglvdvvvssvdyivnfaaeshvdrsied pqifiksniigtqvlldaaykyqikkflqvstdevygslgpegyftettplqanspysaskagadlmvraygetfdlpinitrcsnnygpyq fpekliplmisnaledkelpiygdgknirdwlhvydhcsaidlvlhkgigevynigghnekqnieivklilkeldkpeslikfvkdrlghd rryaidstkiteelgwkpkytfetgivetihwylngdwmekvksgeyqeyyekmyskk |
| Contig40_gene_112_5 | 303 | mkvsvvtpnyglkflnayfetlafqsrfieeiiidnastdascdlieeyinspsykidikliknokdnlgfapavnqgirlakseliysvn ndvelefntietligsmersieegknpfsiqskmiqyhnrsliddagdeynllaytkklgdgspidnynekreifsscagaalyrksileki glfddnffayvedidlsfraqingyrnylepksilyhygsatsgsrynefkirlaarnnvwmiyknfpiplkivnfififlgffikylfflr kgfgsiylggvkeglrerkgiekthfewknwknyfkiewkmiknntfgyfkk |
| Contig40_gene_112_6 | 304 | mrnidlsiivvnyntfkltrdtidsclaepthytyeiflvdnkstddsleklqeyfkseterglkiipnqsndgfakannialeqakgdfi llnsdtlmkqstidkcmdyitdkghdddidalgckvsladgsldkackrsfpnpansfyklfhinvdsdkndynldldddgiyeidclvga fmlvrttidevglldddaffmygedidwcyrikqagwkivyfgqaeiihykgassedkntkkrnpkiliyefyramyvfykkhytkkynflvn iavyigigvllvfnivrnafrs |
| Contig40_gene_112_7 | 305 | mikenqrilnailviidliviilsiglayfvrfkttiifsvggslpfsdyfiftivciiptyillyyffglykpfrnqssifsgaedivksdi mafiilvailfiiingpnfsrimlllslfgmiltiaervlvlvlrmmrtnnlnlkhmlligdndlafefahkinsktylgyniagflgrke nigkrfegtkfigsfddlprvlkthkfdrvviaiplkyyyhineivdaceeegikaeiipdyykylpakpsvdmlddmpiiniryvplddaf nkfkkivsdyfvsivaiiitspimiltaialkiesppgpiifkqerigyngkpfmmykfrsmkvqddeeksqwttkddprktrigtfirkws idelpqfnvlkrdmsvvgprperpyfveefkktipkymvkhqvrpgltglaqvngyrgntsikkrieydiryvenwsialdvkimfwtvfr rnknay |

FIG. 8C-153

| | | |
|---|---|---|
| Contig45_gene_62 | 306 | mggfilveisivipvynvekylrecldsavnqtfkdieiicindgstdssldilkeyqesddriiifnqenqgpgaarnlginkskgkyvyf ldsddyleinaleklyniceeksldfvlfkllnfndktgkfqtkyynmaflndrigdnvfsykdlydcvfnlavsppaklykrelitdidy pegiifednvfflktllkakriyfldeflynrrrddsltssgsddyydlipsmuylfdicrdlddfellkeglyykfkelyirfskvndv hkeeffnliredclkhkeeidediandklrkrskfiyesvlssddykefhyrirlydknkeindlkkenkslknenkklkkenkh fkstkaykvwkkyskikd |
| Contig45_gene_64 | 307 | mkitvagvgyvgislavllaqkhdvtaittteskaemlnqfispiqddeierffkevregertlnlhtttdkaaaygdadlviiatptnydd vgnffdtsavedaiewtlkvnpdvlmvikstipvgytesvrekygirnlifspeflreskalydnlhpsrivvgcdddmeegqmfadllle gareeekransleqdipillthlteseaiklfantylavrvsyfneldtyaqtkgldtqmiidgvcmdprigghynnpsfgyggyclpkdtk qllanykdvpqtmieavvhsnsvrkefianqiisrnpktvgvyrltmksnsdnfrasaigdvmksikaegipiliyeptlddgsefsrsevv ndierfkresdiilanrldcdvlgdvaekvytrdlfrrd |
| Contig45_gene_71 | 308 | mheyeisiiiptynssktiertihsiltqdfknyemvfvddasnddtvsciqetladkkvnyqlivnknnkgpaycrnrgvfasrgkyivfv dsddliqfnhisslhnyvksdnfdsaftkgikinnqdelidfkvdkydglihlarknkgivrakdlinlellmkipfsfvlliydkeiilnn slefnedyrygedtdfalrylancgnvrvidkytyfyyqeedsisrqvsldrfesvklfesldsyfkeddlreklvhsriprfiifgnmnyff yngynsedvfkkmdvldlfnklrqfkvfekrdwkfylkvrlfllnhrlyyklwlrfknnl |
| Contig45_gene_72 | 309 | mndlkklyvilailiviyvginfsyngldtintlthvnldlgpsmdnandanhikigsssftklskiftw |
| Contig45_gene_73 | 310 | mtkilvtggagfigsnfikymldkypdyeivnldaltycgnlenlediednpnysfvkgnimdeglvdvvssvdyivnfaaeshvdrsied pqifiksnligtqvlldaaykyqikkflqvstdevygslgpegyftettplqanspysaskagadlmvraygetfdlpinitrcsnnygpyq fpekliplmisnaledkelpiygdgknirdwlhvydhcsaidlvlhkgigevynigghnekqnieivklilkelnkpeslikfvkdrlghd rryaidsskiteeelgwkpkytfetgivetihwyldnqdwmekvvksgeyqeyyekmyskk |
| Contig45_gene_74 | 311 | mgkfkivkseiegvfltveptvfedergyfmetynendfkaegidltfvqdnqsksskgvlrglhfqytqpqgklvrvikgevfdvgvdlrkd sptygkwvgeilseenkkqlfipkgfahgflvlsdeaefvykctdfykgddeggiqwndpeigikwplgnlkeediilsekdklwkpmketp tdf |
| Contig45_gene_75 | 312 | mkgivlaggsgtrlypitkavskqllplpydkpmiyypisvlmlagikeiliistprdlpmykellgdgenlgisfsyeaqenpnglaeafii gekfigddnvalillgdnvfhghrfseilkramnleegavifgyytqnpesfgvvefddewnlsveekpknpksnyiipglyfydndvieia knvkpsfrgekeitsvndeylkrglkvellgrgmawldtgthdglleaanfietigkrqsvyvacleeiafingyipkellelaeplkkt nygqyliklakmkk |
| Contig45_gene_76 | 313 | mnrfwndiilplfyefkpeviveigcfkgentknileycyytnsklkvidpnpdssfdpislknkygdkfeflkelslnglniedydavli dgdhnwytvynelklliekrfdqnnfpliiifhdvswpyarrdlyynpelipeefrhpyknlamfpdknelgdiginptfnnavfentpkngvl taiedfldetnlnlsffclnafygfgvlfpsqscdektilqifydsdvigilektylkirftqehiiknknieimnlkdmnslnkknidlt ginsnlekeldklnntkteieikeldklnntnidlkekliistnnqkelekildnlkddktylenelkdlnntkteiekelnkvtndktnlki elnninntnielekivddlcneksslknkindleyanqrtlktienlngdiysktyendslkednllltktnkdfledikninnlnydleqk ilnleeeknsilssktwkfgapfrkisnifnkn |

FIG. 8C-154

| | | |
|---|---|---|
| Contig45_gene_77 | 314 | mtykvsiiipvynaaefiirdtlksienqtmcfediev1lvndcstdntakvineyakehenivpinlkenngqpgiprnigityasadylm fldqddtfkknacetlynkistenvdmvcgnhnivsngrsnicinfdwaeedeikinkidenpnfltmgvaawskilrrefvldnnlkfteg vgedifssirallaegilllknfivvdylvrgeslshqvnaeyldefcefylnffnyceknikndnlyhplfngrlnhvlsmlffadlyfd dlswvlikihelfkkvaekpfvfedtsyriffdtlikdeypfensiniysaiksnrerkfdkgvkyleqeaklyidngngfnekdsiianyk lyefnevefnlenfknikrirfdpitwnfincvihkeiktnngdllyeainsinrrelyglnkeeqssnrnskeniryksdssaegiadif lttdsqyllygdfnnlksikinfevnlidnnevskivenlienydh |
| Contig45_gene_78 | 315 | msiknkflslfnsssnnsdfenlnnyykkvledienedisgydrnlkyndlkdcelfsseeyyitngglelseeyalahylnegykqsrnps pefnndkylrflypdvrlaslnplahyvlygekegrrlplseyeeleneivsvknliyqnrvtdnlvllrdkvskgkkvnvfvlpanmfvyk dlynyfdnddmfnvqilvlvphrlgnsqkitdvakdkhyqifsylkekqynvidgydfeknegidlvstcnpdiifyvlpymrifpktmkisn lpsnilyayipygefvednlddlffngwneiawkifcsteeylinsteksivgssnvvlagsarmdslinfeesdedykwiyskeenkkri iwaphtlarpgmddslsysttdenfeffynyakdhpdiewvirphpllkev1snintnmrvggiadenfaddyffkwes1pnarfheeidy fdlfatadamitdcisfkaeylfankpglilnktgveldgyggeitdawyncdgsdfekieefiedvvvgndylkekreeifnknfnvnlg saskvifdyiknelt |
| Contig45_gene_79 | 316 | mgvvmkknnfnkkitfvanyfwtsikegsksnsyfnydnylkkypdvkesgmnpfkhyllhgideerstnfdeninsyslvensdlfdyeyy ceknnlkfdsyskalmhyleakgykkgynpsikfnaeeyyevrpdvkradvnplvhylkygkievtsmteninlkeyqlvknsnlfdynyyme knhldlrneteaiyhyleigykkgynpsnkfngeiyfkknpdieesgwnplvhylkygkeertdkcdknlkeyslvkesglfdygfykdky dldlnsykrglihylefgykrgykpsrnfdgeeylkrypevkkagfnplvhylkygvneeriglrrisfknfnknydveailenidndvtil lnvedsnnlkecienikskttkdykililihenldeddleyiksnndiellrrsphesfinalnnildnakndiiflknnirtfekwiffklva aysddrigfvspisnystvslinieedeksseflisniskrdyeespipndscvfikkdvfkelkfdessneenwfatfidrglekgwksild dstyvvyqfnevepqqadeydystpyvlenrpsvkfinsdafnnsfqniheyaddnleeniqektrknilfamhyggveftvkdivnaikn dyecvlrafknkmklykvfndyfisikefnikypwtpkmihsdeykqiyfyilinynidileidhllllhtfdiqelakkldipiiltlhdf yyicpsyflldennkycggycgdqprncstrvtwidlpanivewknqwqeymkelfgmcdyiltatdftkdmflehydslksddittliehgr dlirydnnytvpniyqpikilipgvigphkgldfikelkgfdddnrleyhfiggvddelksmgiyhgpyeredfakwvfkikpsfigifsvc aetyshtltesicsgvpvlasnlgalktriesgggwlniddaeetyegildisskeeeykfvtenlkdirissseemgskykelydkltk kedk |
| Contig45_gene_80 | 317 | mefikyksqfekmidnkiigmpelidsnisfkgknnilccnniklenididfngnnsviflgsnlgvnshltifnnstflgiknntcgssis isvaenqnliigdncivesdvkirtsdnypiynyensrinhsnsvfigdnvllgessfisrgvkigsgsiispcsflpplfkafsnsyvlgn pqriikedvyfvndsindytieeiknssinenesqlfdfveketlsldkidnilkkfnsedsldfiqklflqnkhknrffie |
| Contig45_gene_81 | 318 | mkkpktkaqesrekkpnnlksdcmkkilyvlhsgvtggtfltnkdlmknvekefdvyllsaenkfiklfssnnkliklirkyhrnyginve teetetnniswsakdfhnswlsniyfeilvnynidivhirhlinhsfdlpqvaeklnipivlshdfyflcpfytlldenynycagecshnk kncycpmdslsdinskefissewrvnvlkmfnyinvfvttsffvkdlflsiysnediinnnnfkviehgrdfpklkkqmfeipssnkpkilc panhlnimkgsqlikrikeednknliefhflgnchdgieeygfshgtferdefhkkveeikpsfvgifsiwpetfchtiteawscgipvigt nigviqdrilnkggwivdrnnpkkayeymaeifenkeeyleianniktmdlkdtkmmsieyiqiynnlleik |

FIG. 8C-155

| | | |
|---|---|---|
| Contig45_gene_82 | 319 | mtkvsviipiyngekylkecldsvccqslkdiqiicvndgstdktlsilngfaskdkrikiistenrggsaarntalkeaqgeyisfvdadd<br>wisenalellyfhaksk dldmlffqminymdnsknyvetelynhlcfernaidedtifnfndikeflfkipvcpvsklykkefldsndlyfp<br>egmffednaffynslfksnclgflkkhlyyrrhadsvtqtfdkrkfdivkatnkvldvflendqylifkkelinhtfsmllewfnksplel<br>kdefyrlikrdfrgfnnlkedfknnlkeeyllfdisdknkyyldflseyklssadyidfdkeryfhinsqeyleyksnksnnykisvvipi<br>ynnetfihrtlmsiengsfglenievimvndnskdntelvineysskyenfkaihikegtgspgprniglyestsdyvifldhddyfeida<br>leklynaineedcdfvygtyasvdedlptkiiypnelhgyfkniygnprsiafpppsiwtklfkrsflienriifptilgedaifiskalfs<br>adgidylwddlicyhtlnkksftknvsydylvqgfvseeylyniyndfesqsyelkenstipseksseniekmnlykirsegildfylngfy<br>rsdlndediyrifpilsdfvstri |
| Contig45_gene_83 | 320 | maliekneflleeivkknfaakykdsilgifwsilkplimiltiifsnlfggsienypvyflsgkiifdffnsatsvsmmslkgninil<br>krtaapkhiftlagvvseflnflitliliigvmivtrspfyilesmiaiipimsliimitgislilavlcvyfsdiqhlwgvitlmlmyasa<br>ifypmniipepfhgimilnpifwvigqfrilvlwgtipsrmmnlnlvllsviillvfgiiivfkkfekkitlkf |
| Contig45_gene_84 | 321 | mnqkrdelnskqninldseneisssseinlkkrdpqnksdliaqqrmkakrelierynmseseaestlqkhkkir |
| Contig45_gene_85 | 322 | mqkknkkitnekeieinsnkvrmddkncslensagvsenkdkndeaikiqsqnsqiegeseeiipehvlerqnpkidnsdyeinsvsdtlp<br>vieegeskpiqnaedeivkkelvdsvsdvvpvvgekeennepiikkddssdvdddvlssiipeyhqkssievnvslsfhiendkidnlkeyi<br>irtlkrtkekkikfhalnnitfkiykgekvgiigyngagkstllnvitgiyepdegnvktygkisplslgagfdynysgreniylngavlg<br>ydkkfleskfdeivefselqdfidlpiknyssgmlaklgfsiativepdilildevlgvgdvnfqkksnkikslmdggttvllvshsivqi<br>reicdkaiwidkgelrefgevnevcdhylkdagnatknqvkdirfn |
| Contig45_gene_86 | 323 | mnykisilipvynvenyieksinsiisqsigienlevilvddnstdnsanilkkyvskydnfkgiycdigsfcgrprniglsyatseyimy<br>ldsddwleetacevlyntiinenadivcgsqtrldnegnrkfyyhlwvttltdpnedyntrmkttqeiiddpnfklvvtldknpnilghan<br>vwgkifkkdliteneisfpedivaqdsvfllnsffvaekivfindiivhynnlrcddddksasyvkttknlfgrikaydlmdnniskkfskee<br>ffyryllvgklnywfnsflmdsnistyceiklfkkyshlfsncykfntnlrkdiknifkeidegnydiaastvsklqsksfsasenkikvsv<br>iipiynneksfiskcldsvingtlneieiciddgssdnsieilnqvlkdsrlkiisqenlgaatarnnglkiakgeyiafldsddwlelna<br>feklyenittnnsdlvifnsiehkenanlkerihiknd sipdynyytfnynykkdlvmngyldiwskmyrtsflkennigfsnhqifndigtf<br>hiktmlnakisycpeflynylrinhpslqnnlsignesfiildideledyl ldnefynelksnfirfkltelestleklenpyrneffkl<br>iknnfkkmqlteyqrkelppenyqffndvltydsffeyalknsekerqklsnaladsekdrqklsndlensgkerqlsdalvdsekerekl<br>sdalessekerekls dalesseierqklsnalessekerqklsndlknsekeqelikkeftssnswkvteplrkirrtikk |
| Contig45_gene_87 | 324 | mdkneiftlwipdnddnmlsqlahlslksfllcdydvilytydhignvpngvcirdaneildksk ifrykggfktysgfanlfrykrlyeyg<br>gtwldldllikrlsdediiigsqtqediysnpnalfrfppkdpliktildysekrgsdinhaetgtlilkllasefpeynqylkhfnys<br>nivnwndvgdylespeifl kclntneiygfhlfntffkkfvefpkdsffttlkdiilnsstseeyafnlmkynittqkyginewdlsyln<br>ifkdafsknefkytilidsqnlkkmeiyniir aifssyglesekdiqliicgksdighdkikfkdnviflasdfgdmkyyindyifgehifp<br>inkpvifkeeffknnnftsdvehhvlnnsnsilnvlnresyklcllanidvfnldmdvlktlnmrikevdnsliydysfrdddvlkmklvd<br>qcdsksflnvkselsnlnikflsqktsyhyfsaykn ilnsnsydefilkehndklqclnafylnrinprydy |
| Contig45_gene_88 | 325 | mladefiisdngqnpreiikkinenyyylikwityvptnnddynikfipkrithvrdesleqyykvvpkkvvndfnvrvemgnhnlkfdn<br>fnrnelvkkdlnlkiahfplrsiegciskvsigwpniiainlynlswgfhwkmlfdkikeendisldd leffaknyalvstsddiliknqpi<br>nldfcdkieirydfeynylrnilenyafaeeivsfkrklksvpilddrfilklasdydvieksglfdvnwyckrys pprninpiihyllty |

FIG. 8C-156

| | | |
|---|---|---|
| | 326 | renmndpagffsteyyfkthvdvansgmnpfvhyikygkkenrkiassksenfgvq |
| Contig45_gene_89 | | |
| Contig45_gene_94 | 327 | mnlmkitvagvgyvglsiaillaqkhdvtaitttteskaeklnqfispirddeierffketrdgkrklnlhtttdkesayknadlviiaaptn yddvnhffdtsavedaiewtlkvnpdvlmvikstipvgysesvrekygvkniifspeflreskalydmlhpsrilvgcdddqkedaqmfvdl llegvrleekrsdspkqdipiliapfteveasklfqntylalrvsyfneldtfaqtkglntniiidcvcmdprigghynpsfgyggyclpk dtkqllanckdvpqalieaivnsnavrkefiadqlisnnpktvgiyrlimksnsdnfrasaiqdvikmikaegikiliyepilddgseflks evvndldifkresdiilanrfdqdilgdvadkvytrdlfgrd |
| | 328 | mgfrfsvvmaaynsgayiqetldslinqsldfkeniqvilvndassdntesvcqeyiknypnniilinnrincgpahtrnvglhyaegelin fldsddyiskktfervdsffedfvhvdmasipikfvgskrgdhplnykykgtgvinllnnpdaiqlssasaffrsdilkaslfnhsrsrydg svsvvyndnspvsdsipmifnenlsvsedallinqmlirnpllgilsnctyfyrkkatdntslisdsanhrsyftsrvnnymirlindsldl ygkvpefiqyvmydlqwimeirqvdhlldledlthlydklisilfyigdkvifnqrsipsilkshillkyfgwgylddktfnfkqidkky ydehgnlipyiekdqlsfiiqkelnkiyldvidikniksknlnnnngtpdddkddgknshdfylsqddedrqelylsgmitsffnsd fdiyaivsekdkssshilekeikvkkisypqrdnlsInfnygynqcfevriplsektsristfrmgtkslnevcnslgietlsedstdyinhh dlafsgdllidynhtsrlsqvsnykiskdylildngnhmivrkrslltikyelvtfasilgereegwrtgillralyfilypfyrnkriwi fmdlpytaddnglqlfksvrnmdklkledynkllidleslisrerhpykyelfegkdiglvgliknvfssiknvfsrdsdddengkvkfkg gslglddkydeledngdysdylnefhgfadvnedyldnqdiqvegssfeddiehsskfrrnvygkagfvksfdakvdakyndsinslenrfd krvsniktrtrnadvrekvqlsrdrddnfskgfspidfiygfdlskflsensfyvlvnyilyriskllrprkikridnrkikkyftleqst shfnnvrhmenqyiassnrdklrkllarekqsneynalkkigpvlayksIkhriyalyaevivsshpdnniiypfgynfphvaglvkaktvf lqhgvtkddvsf |
| Contig45_gene_95 | | mryiadelkgrktsdgkpyefefipkdefslsnmkklatskyifltdnffalafmrfnkktkliqlwhgtgifkkfgydlledeqkktmlkf snkitnlmvsshnvidiyarnfaidkskvlplgiprndyyspehldedyvrqlrgefeqrypnlrgkkivlyaptfredpkynavfnyfdie kfidelgddyilciklhpnynkfadsanridldeltdtynivnfteykdeqklflisnilitcyssvmveytllnrpiilfaydldnylene rgfyfdyrkevpgrivkdtdelvrvirekdfnlsnikefaefqfdyfdaysskrildyvlee |
| Contig47_gene_70 | 329 | mklsiiiptyneeeylpkliesirsqeftdyevivadadsndntreiaeaygcivvdgglpaigrnrgaavakgeillfldsdleltehyle nvieefeeedlgiaitqmtplsqkkrdiylhnlanwfmiavenikphgagcygiisrkelhdecgfdenltfgedtdyiervaeisqfkvl rnakigvstrrleeeglytlkgygkstvndfrgkrtsaedlgyefghesssklesgvqesvpklengvqesvpklessadissqiednsps ledeidiesdhypitaldstdmeriaeksknrkqssfkrrinefkdkefetnelieyedesghikheavgldsrkkifysicqegmghairs svilehltkhhdvyifsserayfklsekfdnvyeiggfntvyennvvrtkttffkamkanptnlkegynvlykeckkvkpniiisdfenyss mlsklmniplisldnihmitqcdydypphkadmltakavtksyilrpkrhiitsfffpplkhpkmtalyppvlrkeimdlesesgdhvlvy qtaessinlmdelkkldeefivygfnkdgtdenltyrafnedkiyedmrtakaiivngftmiseaiylkkpiystpahknfeqilngfyve klgygeshedldvkkiekfldnldtyqnnlnkvekwdntailedldlsiemyakny |

FIG. 8C-157

| Contig47_gene_408 | 330 | mekqqvktilksvviiailliivfglraqsvdiggvpnelkshyvdenglpyfsemdsyfnyrmtenymdhgyfgdtkvngtgwdmhsyfps<br>gravgdyqpmiayvtsflygiinmfqemsllevafwtgaivsslaviptyiftrritndygaiaaslivvlgpnyishtfagffdtdmfnit<br>lplffilffvealktdklsyriifsllavasialyslswtgymfyvavmvlvmivffvlcfyfnieilepfknygnklewlinqkelfatli<br>vlvvgliglllavgvggiiegitgltggftlqagaadvwpnvllsvaemqipnlvtgglvgsflantggvvngvggivclfgvlivlytfvq<br>rlfrlnsvkvkgdtakphkskrkatsvrteqkrfsvslkdigsfgstdeinkskrhtvlylslffvwivssaiavtqgtrfiqvlvvpmgic<br>agifvgyavdyvknnvdndkvllliaviasilialpitqiaygldnamtiglvvlvillaisaiviyakksikdsdvsikkalvvvlitlal<br>vsptvcgafqttaatvpgssdpmwfamdyvkenstndtviiswwdfgylfqvasdhptsfdggsqtgdraywvgksltsdyaqskgilqml<br>attgsnasmllseytgsnvtavhaldetlgksrseaqkiltskynltndqakavvkqshpsnpnnvsfvlssdmigkagwwsyfgswnfdtl<br>nstnyqyymandyvpikqntggnitilnesgiiyqavvnrgkngtnettaqmetiwdnnrskidlngteynplkasnliciensyltvnktl<br>nkdgnytlyllgsgddytailmdnnlkdsvftrlfllggigqdtfelsnmqdgvsvwtlrdgssnsddagsq |
| --- | --- | --- |
| Contig49_gene_169 | 331 | msslisiptlpliviialicgilsfistrlvmpwligkleqaeiigkdihkssrpivaemggigiifgfiigifagiilfpvltfqlvvllv<br>vllvgiigmvddlivlsskeklfllflagiplwwvappnvgllymimipiavsitsnltnmiaglngiesglgvismtsltisciilgkydv<br>aiismtmlgtllaflyynkypakvfpgdtgtlliigatiaaiafigrvkliafivllpniidaalkfysagvmerqqhnptqlnedgklvrpe<br>qgfkslirlvlrkpvdektavmmiwgigiifgilgliivallmpgvthdqtfaqfihlkdyfyylg |

FIG. 9A-158

FIG. 9A. ORFs containing membrane-spanning domains identified from *M. ruminantium*: Annotation and position of membrane-spanning domains.

| ORF | ORF Annotation | Number | Topology * |
|---|---|---|---|
| contig40_gene_28 | hypothetical protein | 1 | o26-43i |
| contig40_gene_32 | MFS transporter | 14 | i7-29o39-58i70-89o99-121i128-150o155-177i190-209o213-235i256-278o288-305i317-335o339-361i382-404o424-446i |
| contig40_gene_33 | hypothetical protein | 4 | i7-29o249-271i421-443o447-469i |
| contig40_gene_36 | hypothetical protein | 4 | i7-29o247-269i423-445o450-472i |
| contig40_gene_37 | hypothetical protein | 4 | i7-26o239-261i417-439o444-466i |
| contig40_gene_42 | MFS transporter | 12 | i21-40o50-72i84-103o113-135i142-164o169-191i240-262o272-294i306-323o328-347i368-390o394-416i |
| contig40_gene_43 | Na+-dependent transporter SNF family | 13 | i13-32o42-64i85-107o142-164i177-199o219-241i254-276o291-313i320-342o357-379i386-408o430-452i457-479o |
| contig40_gene_47 | hypothetical protein | 2 | i13-32o38-60i |
| contig40_gene_60 | hypothetical protein | 7 | o20-42i55-72o76-93i100-122o142-159i164-186o190-207i |
| contig40_gene_62 | cobalt ABC transporter permease protein | 7 | o4-26i28-47o57-76i88-110o130-152i286-308o323-342i |
| contig40_gene_74 | hypothetical protein | 3 | o5-27i36-58o228-250i |
| contig40_gene_76 | type IV leader peptidase family protein | 6 | o4-23i28-47o52-71i83-105o120-142i259-281o |
| contig40_gene_127 | Na+-dependent transporter SNF family | 12 | i7-29o42-64i85-107o139-161i182-204o224-246i259-281o316-338i359-381o385-407i428-450o460-482i |
| contig40_gene_131 | diacylglycerol kinase DagK | 3 | i21-39o44-66i91-113o |
| contig40_gene_145 | hypothetical protein | 1 | i21-43o |
| contig40_gene_168 | ammonium transporter, Amt | 11 | o10-32i45-67o99-121i128-150o165-184i191-213o223-245i257-276o281-300i312-334o349-371i |
| contig40_gene_173 | hypothetical protein | 5 | o10-32i45-67o82-104i124-146o150-169i |
| contig40_gene_174 | hypothetical protein | 2 | i21-43o47-69i |
| contig40_gene_175 | Na+ dependent transpporter SBF family | 8 | i12-34o38-60i73-95o100-122i129-151o166-185i197-216o226-248i |
| contig40_gene_176 | heavy metal-translocating | 5 | o308-330i508-530o545-567i851-873o878-897i |

FIG. 9A-159

| | | | |
|---|---|---|---|
| | P-type ATPase | | |
| contig40_gene_183 | ferrous iron transport protein B FeoB | 10 | o319-341i353-375o390-412i433-455o465-487i494-513o555-577i584-603o623-645i652-674o |
| contig40_gene_188 | hypothetical protein | 3 | o5-39i51-73o100-119i |
| contig40_gene_215 | transporter MIP family | 6 | i12-34o54-73i99-121o141-163i175-197o217-239i |
| contig40_gene_218 | xanthine/uracil permease | 10 | i2-21o25-47i54-76o86-108i115-134o154-176i236-258o268-290i302-321o325-347i |
| contig40_gene_220 | hypothetical protein | 12 | o18-35i67-89o93-114i121-143o176-198i234-256o307-326i346-363o367-386i399-418o422-439i451-473o |
| contig40_gene_230 | hypothetical protein | 2 | o75-97i109-131o |
| contig40_gene_246 | hypothetical protein | 4 | o5-24i31-53o57-79i91-108o |
| contig40_gene_247 | NADH-ubiquinone oxidoreductase subunit | 7 | o5-24i65-87o124-146i158-180o205-227i234-256o266-285i |
| contig40_gene_249 | NADH-ubiquinone oxidoreductase subunit | 6 | o20-42i73-90o95-113i126-148o163-185i198-220o |
| contig40_gene_250 | hypothetical protein | 6 | o15-36i43-65o70-92i122-151o166-188i195-217o |
| contig40_gene_253 | hypothetical protein | 3 | o4-25i32-49o54-73i |
| contig40_gene_254 | hypothetical protein | 3 | o5-20i27-45o50-72i |
| contig40_gene_255 | hypothetical protein | 3 | i5-27o71-93i114-136o |
| contig40_gene_256 | hypothetical protein | 3 | i2-19o29-51i58-80o |
| contig40_gene_268 | hypothetical protein | 1 | o10-43i |
| contig40_gene_273 | hypothetical protein | 6 | i30-48o58-77i84-106o111-129i136-158o193-215i |
| contig40_gene_282 | ABC transporter permease protein | 4 | o20-39i249-271o303-325i337-359o |
| contig40_gene_284 | MatE efflux family protein | 12 | i21-43o53-75i95-117o137-159i166-188o194-216i258-280o285-307i320-342o362-384i397-415o419-441i |
| contig40_gene_287 | hypothetical protein | 2 | o29-51i64-86o |
| contig40_gene_290 | NADP-dependent alcohol dehydrogenase | 1 | i67-189o |
| contig40_gene_301 | ABC transporter permease protein | 6 | i21-43o53-75i96-118o128-150i163-185o215-234i |
| contig40_gene_326 | hypothetical protein | 6 | i12-34o49-71i97-119o164-186i211-233o238-260i |
| contig40_gene_338 | hypothetical protein | 4 | o25-44i79-101o131-153i196-218o |

FIG. 9A-160

| | | | |
|---|---|---|---|
| contig40_gene_356 | YhgE/Pip-like protein | 6 | i28-50o450-470i491-513o518-540i553-575o606-628i |
| contig40_gene_366 | polysaccharide biosynthesis protein | 1 | i28-47o |
| contig40_gene_368 | polysaccharide biosynthesis protein | 14 | i13-32o42-64i84-106o110-132i144-166o171-193i218-240o250-272i292-314o329-351i358-380o384-406i413-435o440-457i |
| contig40_gene_378 | acyltransferase | 8 | i13-30o45-64i84-106o121-143i150-169o179-198i210-227o242-264i |
| contig40_gene_379 | hypothetical protein | 2 | o15-37i50-72o |
| contig40_gene_387 | hypothetical protein | 6 | i20-42o52-74i105-127o132-154i175-197o207-229i |
| contig40_gene_401 | hypothetical protein | 1 | i211-233o |
| contig40_gene_428 | 2-polyprenylphenol 6-hydroxylase UbiB | 2 | i485-507o511-533i |
| contig40_gene_433 | Transposase | 1 | i49-68o |
| contig40_gene_465 | hypothetical protein | 4 | o5-27i59-81o101-123i144-166o |
| contig40_gene_471 | peptidase M50 family | 6 | i12-30o35-57i70-92o112-134i146-168o183-202i |
| contig40_gene_475 | ABC transporter permease protein | 3 | o217-239i271-293o308-330i |
| contig40_gene_481 | ABC transporter permease protein | 5 | i23-45o83-105i126-148o187-209i247-269o |
| contig40_gene_482 | ABC transporter permease protein | 6 | i12-34o105-127i148-170o185-207i246-268o296-318i |
| contig40_gene_487 | ABC transporter permease protein | 6 | i12-31o46-68i89-120o135-157i164-186o206-228i |
| contig40_gene_495 | protein export membrane protein SecF | 6 | i7-24o113-135i142-164o168-190i211-233o243-265i |
| contig40_gene_496 | protein export membrane protein SecD | 5 | i13-32o240-262i269-291o343-365i372-394o |
| contig40_gene_498 | hypothetical protein | 5 | o5-22i29-51o66-88i95-117o121-140i |
| contig40_gene_510 | MatE efflux family protein | 12 | i22-44o59-81i102-124o139-158i171-193o198-217i252-274o284-306i318-340o363-385i392-414o424-446i |
| contig40_gene_514 | hypothetical protein | 6 | i2-21o41-63i75-97o117-139i152-171o194-216i |
| contig40_gene_526 | MatE efflux family protein | 12 | i25-47o57-79i99-121o136-158i171-193o198-220i254-276o286-308i328-350o365-387i400-422o426-445i |
| contig40_gene_535 | amino acid carrier protein | 9 | o10-29i140-162o177-199i206-228o243-262i298-320o340-362i383-402o407-429i |

FIG. 9A-161

| | | | |
|---|---|---|---|
| contig40_gene_541 | AGCS family | 11 | i21-43o73-95i108-13oo148-17oi182-204o209-228i268-287o291-313i334-356o371-393i415-437o |
| contig40_gene_544 | MatE efflux family protein | 1 | i42-64o |
| contig40_gene_552 | methylthioribose-1-phosphate isomerase MtnA | 5 | o15-37i56-78o88-11oi131-153o182-204i |
| contig40_gene_561 | ABC transporter permease protein to 166 | 1 | o10-32i |
| contig40_gene_562 | hypothetical protein | 12 | i30-52o57-79i106-128o138-160i173-195o229-248i268-290o313-335i394-416o421-440i447-466o493-515i |
| contig40_gene_565 | transporter SSS family | 9 | o10-32i52-74o89-111i118-140o155-172i196-218o228-250i330-352o362-384i |
| contig40_gene_570 | transporter sodium:dicarboxylate symporter family | 4 | i19-41o46-65i72-94o104-121i |
| contig40_gene_571 | hypothetical protein | 1 | o56-74i |
| contig40_gene_574 | hypothetical protein | 1 | o336-358i |
| contig40_gene_578 | hypothetical protein | 8 | i41-63o67-89i249-266o276-298i788-81oo820-837i850-872o882-904i |
| contig40_gene_579 | cation-transporting P-type ATPase | 1 | o10-32i |
| contig40_gene_602 | hypothetical protein | 1 | i7-29o |
| contig40_gene_608 | 2-oxoglutarate ferredoxin oxidoreductase subunit gamma korC | 3 | i7-26o188-207i214-236o |
| contig40_gene_609 | sortase family protein | 1 | i259-281o |
| contig40_gene_610 | hypothetical protein | 8 | i12-34o39-58i70-92o97-119i131-153o157-179i184-206o211-233i |
| contig40_gene_616 | phosphatidylserine synthase PssA | 1 | i21-43o |
| contig40_gene_617 | transporter ExbD/Tol family | 3 | o15-37i125-146o161-183i |
| contig40_gene_635 | transporter MotA/TolQ/ExbB proton channel family | 5 | i21-43o48-70i93-115o120-139i146-168o |
| contig40_gene_638 | hypothetical protein | 7 | o44-63i68-90o100-131i271-293o298-320i609-63io635-652i |
| | heavy metal translocating P-type ATPase | | |

FIG. 9A-162

| | | | |
|---|---|---|---|
| contig40_gene_657 | polysaccharide biosynthesis protein | 12 | i41-63o73-95i108-130o134-156i194-213o217-234i255-277o290-312i319-339o344-366i379-396o400-422i |
| contig40_gene_659 | hypothetical protein | 2 | i408-430o434-453i |
| contig40_gene_661 | hypothetical protein | 13 | o20-37i49-71o91-113i120-142o146-163i176-198o233-255i315-337o370-387i392-409o419-441i446-468o483-505i |
| contig40_gene_662 | UbiA prenyltransferase family protein | 9 | i5-27o32-51i82-99o104-121i128-150o154-176i205-227o232-254i267-289o |
| contig40_gene_666 | hypothetical protein | 2 | i7-27o37-59i |
| contig40_gene_668 | alpha-ribazole phosphatase CobZ | 1 | i378-400o |
| contig40_gene_677 | hypothetical protein | 1 | o358-380i |
| contig40_gene_693 | tetrahydromethanopterin S-methyltransferase subunit G MtrG | 1 | i50-72o |
| contig40_gene_694 | tetrahydromethanopterin S-methyltransferase subunit F MtrF | 1 | i41-63o |
| contig40_gene_695 | tetrahydromethanopterin S-methyltransferase subunit A MtrA | 1 | i222-244o |
| contig40_gene_696 | tetrahydromethanopterin S-methyltransferase subunit B MtrB | 1 | i83-105o |
| contig40_gene_697 | tetrahydromethanopterin S-methyltransferase subunit C MtrC | 6 | i7-26o36-58i65-86o101-120i127-149o174-208i |
| contig40_gene_698 | tetrahydromethanopterin S-methyltransferase subunit D MtrD | 6 | i5-27o37-59i66-88o133-155i162-184o210-232i |
| contig40_gene_699 | tetrahydromethanopterin S-methyltransferase subunit E MtrE | 6 | i61-83o87-109i130-152o167-189i231-253o258-277i |
| contig40_gene_713 | hypothetical protein | 11 | o38-60i72-89o99-121i133-155o159-178i198-217o222-244i257-279o283-305i321-338o342-361i |

FIG. 9A-163

| | | | |
|---|---|---|---|
| contig40_gene_722 | hypothetical protein | 5 | o13-35i42-64o69-91i100-119o123-145i |
| contig40_gene_727 | TraB family protein | 4 | i240-262o272-289i296-318o351-373i |
| contig40_gene_729 | CBS domain-containing protein | 1 | o5-27i |
| contig40_gene_731 | sodium/calcium exchanger protein | 9 | i21-43o58-80i93-111o116-133i153-175o185-207i220-242o252-271i280-297o |
| contig40_gene_740 | hypothetical protein | 1 | o10-27i |
| contig40_gene_747 | MFS transporter | 14 | i7-29o33-55i68-90o94-116i128-150o155-172i193-210o214-236i263-285o289-311i323-345o355-377i396-418o471-493i |
| contig40_gene_748 | 2-polyprenylphenol 6-hydroxylase UbiB | 2 | i476-495o505-527i |
| contig40_gene_764 | hypothetical protein | 7 | i28-50o88-110i117-136o172-194i199-221o226-248i269-291o |
| contig40_gene_770 | hypothetical protein | 1 | o4-22i |
| contig40_gene_771 | hypothetical protein | 1 | i104-126o |
| contig40_gene_780 | energy-converting hydrogenase B subunit O EhbO | 8 | o5-27i73-95o99-121i164-186o201-223i257-279o283-305i312-331o |
| contig40_gene_785 | energy-converting hydrogenase B subunit J EhbJ | 3 | o4-26i38-60o64-86i |
| contig40_gene_786 | energy-converting hydrogenase B subunit I EhbI | 4 | i27-49o53-72i85-107o142-164i |
| contig40_gene_788 | energy-converting hydrogenase B subunit G EhbG | 3 | o4-26i28-50o65-84i |
| contig40_gene_789 | energy-converting hydrogenase B subunit F EhbF | 13 | i25-47o85-102i109-128o132-154i166-188o203-225i246-265o270-292i305-327o331-353i365-387o402-424i452-474o |
| contig40_gene_790 | energy-converting hydrogenase B subunit E EhbE | 3 | o5-27i46-68o83-105i |
| contig40_gene_791 | energy-converting hydrogenase B subunit D | 3 | o4-19i26-45o49-71i |

FIG. 9A-164

| | | | |
|---|---|---|---|
| contig40_gene_792 | EhbD | | |
| | energy-converting hydrogenase B subunit C EhbC | 3 | o10-32i44-66o70-92i |
| contig40_gene_793 | energy-converting hydrogenase B subunit B EhbB | 3 | i5-27o37-59i66-85o |
| contig40_gene_794 | energy-converting hydrogenase B subunit A EhbA | 1 | i7-29o |
| contig40_gene_795 | hypothetical protein | 7 | i9-31o46-80i87-109o124-143i150-167o172-194i214-231o |
| contig40_gene_800 | potassium channel protein | 3 | i31-53o57-76i81-103o |
| contig40_gene_803 | hypothetical protein | 7 | i7-26o36-55i128-147o151-173i225-247o267-289i310-332o |
| contig40_gene_804 | potassium uptake protein TrkH family | 10 | i2-19o24-41i62-84o124-146i167-189o219-241i254-271o309-331i372-394o434-456i |
| contig40_gene_816 | 4Fe-4S binding domain-containing protein | 7 | i5-22o27-49i56-75o85-104i111-133o148-170i177-199o |
| contig40_gene_825 | hypothetical protein | 1 | i21-43o |
| contig40_gene_826 | MotA/TolQ/ExbB proton channel family protein | 3 | o24-46i133-155o165-187i |
| contig40_gene_827 | hypothetical protein | 7 | o5-24i31-50o60-82i102-124o134-156i168-190o200-222i |
| contig40_gene_832 | hypothetical protein | 1 | i21-43o |
| contig40_gene_833 | MotA/TolQ/ExbB proton channel family protein | 3 | o48-70i158-180o190-212i |
| contig40_gene_838 | hypothetical protein | 1 | i7-24o |
| contig40_gene_839 | hypothetical protein | 1 | o5-27i |
| contig40_gene_888 | restriction endonuclease | 3 | o323-345i352-37o381-398i |
| contig40_gene_890 | undecaprenyl-diphosphatase UppP | 7 | i7-29o39-61i94-116o120-139i192-211o221-243i255-273o |
| contig40_gene_905 | hypothetical protein | 7 | i26-48o53-75i95-117o121-140i161-183o193-215i228-250o |
| contig40_gene_912 | hypothetical protein | 11 | i9-26o31-49i65-87o91-108i121-143o153-175i182-204o219-241i262-281o296-315i322-344o |
| contig40_gene_920 | polysaccharide | 12 | i13-35o55-74i95-116o126-148i169-203o248-270i319-341o351-373i385-407o411- |

FIG. 9A-165

| | | | |
|---|---|---|---|
| | biosynthesis protein | | 430i437-459o463-485i |
| contig40_gene_926 | hypothetical protein | 6 | i13-35o50-72i84-106o116-135i166-185o195-214i |
| contig40_gene_929 | hypothetical protein | 10 | i12-34o44-66i106-128o143-162i169-200o210-232i253-275o308-330i343-362o366-384i |
| contig40_gene_941 | hypothetical protein | 8 | o15-37i50-69o84-106i113-135o139-161i168-190o205-227i239-261o |
| contig40_gene_953 | peptidase C39 family | 2 | o277-299i475-494o |
| contig40_gene_957 | hypothetical protein | 1 | i84-106o |
| contig40_gene_958 | hypothetical protein | 1 | i218-240o |
| contig40_gene_960 | glycosyl transferase GT2 family | 3 | i222-244o249-271i295-317o |
| contig40_gene_962 | transporter permease family protein | 3 | o10-32i44-66o86-103i |
| contig40_gene_963 | transporter permease family protein | 9 | i19-41o46-68i75-97o101-120i133-155o165-187i194-216o254-276i296-318o |
| contig40_gene_966 | hypothetical protein | 10 | i12-29o44-63i76-98o108-127i140-158o163-182i195-217o230-252i287-304o314-336i |
| contig40_gene_971 | hypothetical protein | 5 | o41-63i76-98o108-127i148-170o180-202i |
| contig40_gene_983 | Na+-dependent transporter SNF family | 12 | i13-32o42-64i85-107o142-164i177-199o219-241i254-276o315-337i358-380o384-406i427-449o459-476i |
| contig40_gene_988 | hypothetical protein | 1 | i46-68o |
| contig40_gene_989 | hypothetical protein | 1 | i20-42o |
| contig40_gene_991 | ABC transporter permease protein | 8 | i17-39o258-280i301-323o343-365i420-442o633-655i686-708o723-745i |
| contig40_gene_993 | divalent cation transporter mgtE family | 12 | i12-34o54-73i78-100o130-152i165-187o202-224i231-253o263-285i298-320o340-362i383-405o420-442i |
| contig40_gene_1003 | cobalamin biosynthesis protein CobD | 6 | o20-42i49-71o81-103i169-191o226-245i306-328o |
| contig40_gene_1007 | ABC transporter permease protein | 8 | i13-35o50-272i303-325o340-362i419-441o623-645i680-702o717-739i |
| contig40_gene_1012 | Na+-dependent transporter SNF family | 12 | i7-29o42-64i85-107o140-162i174-196o220-242i255-277o315-337i358-380o385-407i427-449o459-481i |
| contig40_gene_1022 | hypothetical protein | 1 | i5-27o |

FIG. 9A-166

| | | | |
|---|---|---|---|
| contig40_gene_1023 | hypothetical protein | 3 | o200-222i227-249o259-281i |
| contig40_gene_1024 | hypothetical protein | 1 | i163-185o |
| contig40_gene_1050 | hypothetical protein | 6 | i20-42o60-77i90-112o122-144i156-173o183-205i |
| contig40_gene_1052 | MFS transporter | 13 | i13-35o45-65i78-97o102-124i137-159o163-182i202-221o225-244i270-292o297-319i332-354o365-387i408-430o |
| contig40_gene_1053 | hypothetical protein | 6 | i21-40o45-67i80-102o117-134i147-166o176-198i |
| contig40_gene_1056 | hypothetical protein | 4 | i19-41o46-68i73-95o99-121i |
| contig40_gene_1077 | SpoIIE family protein | 8 | i7-29o39-61i82-104o114-136i157-179o184-203i224-246o256-278i |
| contig40_gene_1080 | MatE efflux family protein | 12 | i5-27o32-54i67-89o109-131i144-166o170-189i230-252o256-278i299-321o331-353i365-387o391-413i |
| contig40_gene_1083 | hypothetical protein | 9 | o15-34i46-68o78-97i104-126o146-163i176-198o208-230i237-259o269-291i |
| contig40_gene_1095 | hypothetical protein | 1 | i5-27o |
| contig40_gene_1107 | hypothetical protein | 1 | o15-35i |
| contig40_gene_1109 | isoprenylcysteine carboxyl methyltransferase family protein | 5 | i20-42o47-69i90-112o117-139i176-198o |
| contig40_gene_1125 | glycosyl transferase GT2 family | 1 | o253-275i |
| contig40_gene_1126 | glycosyl transferase GT2 family | 1 | i273-292o |
| contig40_gene_1127 | exopolysaccharide biosynthesis polyprenyl | 5 | i7-29o49-71i92-111o115-137i286-307o |

FIG. 9A-167

| | | |
|---|---|---|
| | | glycosylphosphotransferase |
| contig40_gene_1130 | 10 | o5-24i37-56o66-88i101-123o128-150i163-185o195-217i224-246o251-273i285-304o |
| contig40_gene_1144 | 6 | o4-21i61-83o103-125i175-197o306-328i360-382o |
| contig40_gene_1153 | 14 | peptidase M50 family o10-32i44-66o76-95i100-122o137-159i164-183o198-215i217-239o259-281i288-310o325-342i349-366o395-417i429-451o |
| contig40_gene_1154 | 14 | MFS transporter o10-32i44-66o76-95i102-124o134-156i163-185o195-217i222-241o261-283i288-310o325-342i349-366o395-417i429-451o |
| contig40_gene_1156 | 7 | transporter i29-60o70-89i110-132o162-184i197-216o226-248i261-283o |
| contig40_gene_1161 | 2 | hypothetical protein o27-49i56-74o |
| contig40_gene_1162 | 3 | hypothetical protein o5-24i29-51o66-88i |
| contig40_gene_1165 | 6 | hypothetical protein i9-31o46-68i80-102o107-126i133-150o160-182i |
| contig40_gene_1183 | 4 | hypothetical protein i5-27o66-88i100-122o126-145i |
| contig40_gene_1188 | 2 | hypothetical protein i270-292o307-329i |
| contig40_gene_1199 | 6 | cytochrome C-type biogenesis protein DsbD i9-31o41-63i70-92o107-129i142-164o179-201i |
| contig40_gene_1202 | 12 | carbon starvation protein CstA i33-55o59-77i105-122o137-156i163-184o204-223i244-266o286-308i339-358o362-381i388-407o417-439i |
| contig40_gene_1210 | 1 | hypothetical protein o10-32i |
| contig40_gene_1212 | 12 | hydroxymethylpyrimidine transporter CytX i7-29o39-62i75-97o112-134i141-163o178-200i213-232o247-269i289-306o310-332i344-363o368-390i |

FIG. 9A-168

| | | |
|---|---|---|
| contig40_gene_1213 | phosphomethylpyrimidine kinase | 1 | i21-43o |
| contig40_gene_1214 | molybdate ABC transporter permease protein ModB | 5 | o15-33i46-68o83-105i133-155o195-217i |
| contig40_gene_1221 | heavy metal translocating P-type ATPase | 8 | i161-183o193-212i224-246o250-269i408-430o435-457i768-790o795-814i |
| contig40_gene_1222 | potassium uptake protein TrkH family | 9 | o22-44i56-78o116-135i168-190o210-232i253-270o305-327i370-392o429-451i |
| contig40_gene_1231 | MFS transporter | 13 | o28-45i57-76o81-103i116-138o142-164i177-194o204-226i255-277o282-304i317-339o343-361i374-396o401-423i |
| contig40_gene_1232 | MatE efflux family protein | 12 | i20-42o52-74i94-116o136-155i168-190o194-216i255-277o282-304i324-346o361-383i396-415o419-441i |
| contig40_gene_1239 | hypothetical protein | 10 | i20-42o57-79i91-113o128-150i162-184o199-216i229-251o266-288i309-327o337-356i |
| contig40_gene_1240 | hypothetical protein | 3 | i20-42o46-68i75-97o |
| contig40_gene_1242 | hypothetical protein | 6 | i20-42o57-79i105-127o131-153i182-204o209-231i |
| contig40_gene_1249 | CAAX amino terminal protease family protein | 8 | i21-43o48-70i83-105o131-153i166-183o188-207i212-234o244-266i |
| contig40_gene_1250 | CAAX amino terminal protease family protein | 7 | i20-42o47-64i85-107o131-153i165-187o207-229i236-258o |
| contig40_gene_1252 | hypothetical protein | 4 | i42-64o74-96i132-154o174-196i |
| contig40_gene_1253 | hypothetical protein | 6 | i22-44o71-93i123-145o155-177i209-231o246-268i |
| contig40_gene_1256 | hypothetical protein | 1 | o4-26i |
| contig40_gene_1257 | CAAX amino terminal protease family protein | 5 | i59-81o96-118i138-172o182-204i209-231o |

FIG. 9A-169

| | | | |
|---|---|---|---|
| contig40_gene_1258 | peptidase M50 family | 6 | i12-29o34-56i77-99o112-134i141-163o178-200i |
| contig40_gene_1259 | preprotein translocase SecG subunit | 1 | o30-52i |
| contig40_gene_1267 | acyltransferase family protein | 11 | o4-26i39-61o81-99i106-128o133-155i162-181o185-203i215-234o244-266i287-309o319-341i |
| contig40_gene_1271 | ABC transporter permease protein | 8 | i12-34o67-89i102-119o123-145i152-174o203-225i246-268o311-333i |
| contig40_gene_1284 | hypothetical protein | 1 | i23-45o |
| contig40_gene_1299 | hypothetical protein | 1 | o20-37i |
| contig40_gene_1300 | hypothetical protein | 1 | o25-44i |
| contig40_gene_1304 | hypothetical protein | 3 | i37-59o69-91i132-154o |
| contig40_gene_1315 | hypothetical protein | 1 | i13-35o |
| contig40_gene_1327 | hypothetical protein | 1 | i164-186o |
| contig40_gene_1339 | phage tail tape measure protein | 5 | i96-118o180-202i209-231o321-343i356-378o |
| contig40_gene_1352 | hypothetical protein | 7 | o4-26i33-53o63-85i97-116o121-143i156-178o198-220i |
| contig40_gene_1353 | hypothetical protein | 3 | o20-42i128-150o165-184i |
| contig40_gene_1354 | hypothetical protein | 1 | i20-42o |
| contig40_gene_1356 | formate/nitrite transporter FdhC | 8 | i28-50o65-87i115-137o141-163i175-194o198-217i222-244o248-270i |

FIG. 9A-170

| | | |
|---|---|---|
| contig40_gene_1378 | MatE efflux family protein | 11 | o31-53i66-88o108-130i137-159o169-188i216-238o253-275i296-318o333-355i362-384o389-411i |
| contig45_gene_1 | C4-dicarboxylate transporter/malic acid transport protein Tdt | 10 | i7-25o29-51i58-80o95-117i129-148o153-175i187-209o213-235i242-261o276-295i |
| contig45_gene_10 | major facilitator superfamily protein | 11 | o15-37i50-72i85-107i144-166o170-187i220-242o257-279i286-305o315-337i350-372o377-399i |
| contig45_gene_29 | conserved hypothetical protein | 2 | i324-343o363-397i |
| contig45_gene_38 | conserved hypothetical transmembrane protein | 6 | i21-40o50-72i92-111o121-143i173-195o199-221i |
| contig45_gene_52 | phospho-N-acetylmuramoyl-pentapeptide-transferase MraY | 10 | o15-37i58-80o85-107i175-197o201-220i227-246o251-268i275-294o298-317i346-368o |
| contig45_gene_67 | conserved hypothetical transmembrane protein | 3 | o32-66i73-95o141-163i |
| contig45_gene_72 | hypothetical protein | 1 | i7-25o |
| contig45_gene_83 | polysaccharide/polyol phosphate ABC transporter permease protein | 7 | i27-49o69-91i104-126o141-163i170-189o199-221i228-245o |
| contig45_gene_96 | conserved hypothetical protein | 1 | i20-42o |
| contig45_gene_97 | conserved hypothetical transmembrane protein | 7 | o4-26i38-55o70-92i104-126o141-163i175-197o212-234i |
| contig45_gene_98 | biopolymer transport protein | 3 | o25-47i133-155o170-189i |
| contig45_gene_99 | ion transport protein | 6 | i2-20o25-47i68-90o121-143i150-172o177-199i |
| contig45_gene_114 | conserved hypothetical protein | 2 | o15-37i42-59o |
| contig45_gene_143 | conserved hypothetical transmembrane protein | 8 | i13-35o77-99i106-123o133-155i168-190o205-227i234-251o256-278i |
| contig45_gene_146 | heat shock protein HtpX | 4 | i12-34o38-57i150-172o182-204i |
| contig45_gene_150 | conserved hypothetical | 1 | i79-101o |

FIG. 9A-171

| | protein | | |
|---|---|---|---|
| contig47_gene_1 | transposase | 1 | i45-64o |
| contig47_gene_12 | hypothetical protein | 1 | i62-84o |
| contig47_gene_21 | hypothetical protein | 2 | o10-34i47-69o |
| contig47_gene_22 | hypothetical protein | 1 | i5-27o |
| contig47_gene_26 | hypothetical protein | 6 | i20-37o42-61i82-104o131-153i186-208o218-240i |
| contig47_gene_35 | hypothetical protein | 6 | i7-24o29-51i56-78o88-110i117-136o141-163i |
| contig47_gene_36 | 2-polyprenylphenol 6-hydroxylase UbiB | 1 | o507-529i |
| contig47_gene_37 | hypothetical protein | 7 | i28-45o49-67i87-109o129-151i158-175o180-202i207-229o |
| contig47_gene_41 | hypothetical protein | 1 | i46-68o |
| contig47_gene_46 | hypothetical protein | 1 | o29-51i |
| contig47_gene_58 | hypothetical protein | 13 | o27-49i70-89o104-125i130-152o167-189i201-223o238-256i269-286o291-313i326-343o348-370i396-418o433-450i |
| contig47_gene_65 | hypothetical protein | 1 | i26-45o |
| contig47_gene_67 | hypothetical protein | 5 | o26-48i50-72o82-99i104-123o128-145i |
| contig47_gene_68 | hypothetical protein | 7 | o18-40i52-74o78-100i112-134o149-171i184-206o221-243i |
| contig47_gene_69 | hypothetical protein | 8 | i9-28o48-65i88-110o115-137i144-163o168-190i211-233o283-305i |
| contig47_gene_79 | hypothetical protein | 1 | o20-42i |
| contig47_gene_80 | MotA/TolQ/ExbB proton channel family protein | 3 | o18-40i127-149o159-181i |
| contig47_gene_81 | hypothetical protein | 1 | o907-925i |
| contig47_gene_86 | V-type ATP synthase subunit C AtpC | 1 | i20-42o |
| contig47_gene_88 | V-type ATP synthase subunit K AtpK | 4 | i7-29o60-82i89-111o143-160i |
| contig47_gene_89 | V-type ATP synthase subunit I AtpI | 7 | o383-405i418-440o469-491i507-529o533-555i567-589o599-621i |
| contig47_gene_91 | hypothetical protein | 4 | i5-24o28-50i57-76o81-98i |
| contig47_gene_92 | hypothetical protein | 1 | o47-69i |
| contig47_gene_99 | hypothetical protein | 10 | o10-32i53-75o81-103i136-158o168-190i202-224o291-313i320-342o352-374i387-409o |

FIG. 9A-172

| | | | |
|---|---|---|---|
| contig47_gene_100 | hypothetical protein | 1 | i12-31o |
| contig47_gene_103 | hypothetical protein | 2 | i21-43o48-67i |
| contig47_gene_116 | type II secretion system protein F | 5 | i42-64o68-89i213-235o250-272i284-306o |
| contig47_gene_123 | hypothetical protein | 4 | i9-31o41-63i76-95o105-127i |
| contig47_gene_125 | hypothetical protein | 2 | i20-42o47-69i |
| contig47_gene_127 | YhgE/Pip-like protein | 6 | i21-43o417-437i458-480o485-507i520-542o569-591i |
| contig47_gene_147 | hypothetical protein | 1 | i92-114o |
| contig47_gene_150 | Na+-dependent transporter SNF family | 7 | o26-48i61-83o122-144i165-187o191-213i234-256o266-286i |
| contig47_gene_151 | Na+-dependent transporter SNF family | 4 | i7-28o43-65i85-107o142-164i |
| contig47_gene_154 | hypothetical protein | 6 | i13-30o40-57i78-100o136-158i192-209o214-236i |
| contig47_gene_157 | hypothetical protein | 1 | i92-110o |
| contig47_gene_163 | transposase | 1 | o15-32i |
| contig47_gene_165 | transposase | 1 | i45-64o |
| contig47_gene_166 | 2-polyprenylphenol 6-hydroxylase UbiB | 2 | i114-136o146-168i |
| contig47_gene_172 | mechanosensitive ion channel protein | 3 | i12-34o61-80i85-104o |
| contig47_gene_174 | hypothetical protein | 4 | i54-73o77-99i193-212o227-249i |
| contig47_gene_179 | MatE efflux family protein | 12 | i21-43o53-75i95-117o132-154i167-189o194-216i256-278o282-304i324-346o361-383i395-417o422-444i |
| contig47_gene_181 | hypothetical protein | 6 | o4-23i36-58o63-85i106-128o132-154i167-189o |
| contig47_gene_185 | hypothetical protein. | 1 | i114-136o |
| contig47_gene_187 | hypothetical protein | 5 | o41-60i73-92o102-124i156-173o209-231i |
| contig47_gene_190 | hypothetical protein | 2 | i5-27o40-62i |
| contig47_gene_191 | band 7 family protein | 1 | o4-21i |
| contig47_gene_192 | hypothetical protein | 4 | i9-27o32-54i61-83o103-125i |
| contig47_gene_193 | hypothetical protein | 3 | o40-62i69-91o101-123i |
| contig47_gene_209 | hypothetical protein | 11 | o15-34i47-66o81-103i136-158o168-190i202-224o274-293i300-322o327-344i351-373o388-410i |

FIG. 9A-173

| | | | |
|---|---|---|---|
| contig47_gene_212 | transposase | 1 | i45-64o |
| contig47_gene_219 | hypothetical protein | 2 | o26-45i65-96o |
| contig47_gene_220 | hypothetical protein | 2 | i12-31o36-58i |
| contig47_gene_226 | hypothetical protein | 6 | i2-21o26-43i55-77o82-101i108-130o134-153i |
| contig47_gene_234 | MFS transporter | 11 | i7-29o44-66i73-90o94-116i135-157o161-182i203-225o240-262i269-30o327-349i356-378o |
| contig47_gene_235 | hypothetical protein | 2 | o15-49i70-92o |
| contig47_gene_246 | CAAX amino terminal protease family protein | 7 | o20-42i63-85o95-117i124-146o151-169i176-194o209-226i |
| contig47_gene_248 | hypothetical protein | 5 | o10-32i62-84o104-121i128-146o161-183i |
| contig47_gene_250 | hypothetical protein | 1 | o10-32i |
| contig47_gene_251 | hypothetical protein | 8 | i36-53o63-85i119-141o156-178i199-221o231-253i367-389o393-410i |
| contig47_gene_252 | cobalt ABC transporter permease protein CbiQ | 5 | i28-59o74-96i109-131o146-165i243-265o |
| contig47_gene_254 | cobalamin biosynthesis protein CbiM | 5 | i21-43o53-75i88-110o125-147i154-176o |
| contig47_gene_256 | ferrous iron transport protein B FeoB | 10 | i288-310o320-342i347-369o389-411i424-446o456-476i512-534o569-591i611-633o648-670i |
| contig47_gene_258 | hypothetical protein | 1 | o15-34i |
| contig47_gene_265 | hypothetical protein | 1 | o56-78i |
| contig47_gene_271 | type II secretion system protein F | 2 | o144-166i173-195o |
| contig47_gene_275 | hypothetical protein | 11 | i5-24o29-51i100-122o132-149i154-176o180-202i223-245o307-329i349-368o372-394i399-415o |
| contig47_gene_281 | serine phosphatase | 8 | i13-35o55-74i95-117o132-154i174-196o201-218i239-261o276-298i |
| contig47_gene_284 | acyltransferase | 10 | i12-34o49-71i92-114o129-148i161-183o187-209i222-241o246-268i281-300o315-337i |
| contig47_gene_286 | hypothetical protein | 5 | o15-37i58-77o112-134i173-190o195-217i |
| contig47_gene_287 | hypothetical protein | 7 | o5-27i63-85o90-107i114-131o136-153i165-187o222-244i |
| contig47_gene_294 | CDP-alcohol phosphatidyltransferase | 5 | o20-42i49-71o91-113i139-156o160-182i |
| contig47_gene_298 | hypothetical protein | 2 | i73-95o105-122i |

FIG. 9A-174

| | | |
|---|---|---|
| contig47_gene_300 | hypothetical protein | 5 | o15-37i58-80o85-107i120-142o146-168i |
| contig47_gene_301 | hypothetical protein | 5 | i9-31o35-57i70-92o102-124i144-166o |
| contig47_gene_302 | hypothetical protein | 6 | i17-39o63-85i97-119o129-146i158-175o188-205i |
| contig47_gene_307 | hypothetical protein | 2 | i44-75o95-114i |
| contig47_gene_310 | hypothetical protein | 1 | i68-90o |
| contig47_gene_316 | protein translocase Sec61-gamma subunit | 1 | o35-57i |
| contig47_gene_328 | hypothetical protein | 5 | i21-43o76-98i110-132o137-159i180-202o |
| contig47_gene_331 | voltage gated chloride channel protein | 10 | o19-41i61-80o158-180i193-212o227-249i262-284o304-326i333-355o365-387i392-414o |
| contig47_gene_338 | hypothetical protein | 6 | i5-23o33-64i93-115o153-175i182-204o214-231i |
| contig47_gene_365 | transposase | 1 | i45-64o |
| contig47_gene_366 | cytidylyltransferase family protein | 7 | o6-23i36-53o57-79i92-111o116-138i155-177o187-209i |
| contig47_gene_371 | hypothetical protein | 5 | i17-36o73-95i102-124o128-147i168-190o |
| contig47_gene_385 | calcineurin-like phosphoesterase | 3 | o5-27i48-70o75-97i |
| contig47_gene_388 | hypothetical protein | 1 | i2-24o |
| contig47_gene_393 | Na+-dependent transporter SNF family | 12 | i13-35o45-67i88-110o146-168i181-203o223-245i258-280o319-341i362-384o388-410i431-453o463-485i |
| contig47_gene_394 | Na+-dependent transporter SNF family | 10 | i13-30o45-67i88-110o145-167i180-202o226-248i261-283o318-340i361-383o387-409i |
| contig47_gene_395 | transporter Na+/H+ antiporter family | 11 | i12-34o49-71i78-100o105-124i187-209o238-260i297-319o358-377i398-420o430-452i522-544o |
| contig47_gene_408 | oligosaccharyl transferase STT3 subunit | 13 | i9-31o125-144i153-175o180-197i204-226o230-252i273-295o345-367i426-443o447-469i481-503o507-529i542-564o |
| contig47_gene_420 | MFS transporter | 14 | i17-39o54-76i88-110o115-137i144-166o176-195i207-229o233-255i275-297o307-329i342-359o374-396i417-439o482-504i |
| contig47_gene_421 | hypothetical protein | 5 | o10-42i49-71o77-99i106-125o130-149i |
| contig47_gene_422 | hypothetical protein | 6 | i21-43o53-75i104-126o165-187i224-246o250-267i |
| contig47_gene_424 | hypothetical protein | 4 | i17-36o46-65i70-92o102-124i |
| contig47_gene_425 | hypothetical protein | 6 | i7-29o56-75i80-102o117-139i159-181o216-238i |

FIG. 9A-175

| | | | |
|---|---|---|---|
| contig47_gene_428 | hypothetical protein | 8 | i7-29o49-68i88-105o109-128i149-171o181-203i215-237o252-274i |
| contig47_gene_431 | transporter small multidrug resistance (SMR) family | 3 | o30-49i56-78o83-105i |
| contig47_gene_433 | ABC transporter ATP-binding/permease protein | 11 | i13-35o55-77i124-146o150-172i237-259o274-293i365-383o403-422i484-503o508-525i601-623o |
| contig47_gene_438 | hypothetical protein | 8 | i7-29o49-68i88-105o109-128i149-171o181-203i215-237o252-274i |
| contig49_gene_6 | conserved hypothetical protein | 2 | i43-65o85-107i |
| contig49_gene_9 | conserved hypothetical transmembrane protein | 6 | i13-32o42-64i91-113o133-151i158-177o187-209i |
| contig49_gene_22 | cobalt-zinc-cadmium resistance protein czcD | 5 | i30-52o56-78i91-113o128-150i187-209o |
| contig49_gene_28 | cation diffusion facilitator family transporter | 6 | i13-35o39-61i81-103o118-140i160-177o182-201i |
| contig49_gene_32 | conserved hypothetical protein | 1 | i20-42o |
| contig49_gene_33 | conserved hypothetical protein | 1 | o46-68i |
| contig49_gene_34 | conserved hypothetical protein | 2 | o5-27i32-54o |
| contig49_gene_39 | conserved hypothetical secreted protein | 3 | o10-32i35-52o67-89i |
| contig49_gene_41 | conserved hypothetical protein | 7 | i21-38o48-70i91-113o123-142i149-171o181-203i582-601o |
| contig49_gene_75 | preprotein translocase SecY subunit SecY | 7 | o15-37i44-66o94-116i147-169o212-231i270-289o293-312i |
| contig49_gene_77 | conserved hypothetical transmembrane protein | 5 | i7-29o39-61i112-134o138-160i173-192o |
| contig49_gene_83 | cobalt ABC transporter permease protein CbiQ | 3 | o5-27i40-62o77-96i |
| contig49_gene_84 | cobalt transport protein CbiN | 2 | i5-27o69-88i |
| contig49_gene_85 | cobalamin biosynthesis protein CbiM | 6 | i7-29o44-66i73-95o105-127i139-161o176-198i |

FIG. 9A-176

| | | | |
|---|---|---|---|
| contig49_gene_101 | conserved hypothetical transmembrane protein | 3 | i20-42o52-74i81-103o |
| contig49_gene_133 | conserved hypothetical protein | 1 | i98-115o |
| contig49_gene_153 | ABC transporter permease protein | 5 | o5-27i34-56o87-109i149-171o186-208i |
| contig49_gene_169 | glycosyl transferase GT4 family | 8 | o4-26i60-82o86-108i115-137o157-179i184-201o216-238i297-319o |
| contig49_gene_173 | conserved hypothetical protein | 1 | i7-29o |
| contig49_gene_191 | Sodium:dicarboxylate symporter family protein | 8 | i13-33o43-65i78-100o137-156i177-199o214-236i292-314o324-346i |
| contig49_gene_201 | heavy metal translocating P-type ATPase | 5 | i21-40o44-66i73-95o243-265i270-292o |
| contig49_gene_205 | ABC transporter permease protein | 5 | o24-43i83-105o131-153i195-217o251-268i |
| contig49_gene_206 | ABC transporter permease protein | 1 | o44-66i |
| contig49_gene_207 | ABC transporter permease protein | 3 | o73-95i116-138o158-177i |
| contig49_gene_217 | ABC transporter permease/ATP-binding protein | 6 | i21-43o63-85i134-156o166-185i246-268o283-305i |
| contig49_gene_218 | ABC transporter ATP-binding/permease protein | 5 | i38-60o75-97i158-175o179-198i276-298o |
| contig49_gene_225 | conserved hypothetical transmembrane protein | 8 | i7-29o49-68i81-115o130-152i203-225o245-267i288-307o311-333i |
| contig49_gene_227 | ATP-dependent protease La LonB | 1 | i229-251o |
| contig49_gene_231 | conserved hypothetical protein | 3 | i5-27o37-54i61-83o |
| contig49_gene_232 | conserved hypothetical transmembrane protein | 3 | i13-33o38-60i72-94o |
| contig49_gene_242 | hypothetical protein | 1 | o52-74i |
| contig49_gene_243 | conserved hypothetical | 5 | i66-88o103-125i138-160o170-192i213-230o |

FIG. 9A-177

| | | | |
|---|---|---|---|
| contig49_gene_247 | transmembrane protein | 11 | o18-40i47-69o91-113i126-145o160-182i191-213o247-269i314-333o348-367i380-402o412-434i |
| contig55_gene_5 | MATE efflux family protein | 5 | i13-35o45-67i69-91o101-123i287-309o |
| contig55_gene_10 | conserved hypothetical transmembrane protein | 1 | o45-62i |
| contig55_gene_14 | hypothetical protein | 10 | i5-27o37-54i67-89o93-115i122-141o145-167i179-201o216-238i243-265o270-287i |
| contig55_gene_27 | conserved hypothetical transmembrane protein | 4 | o4-23i30-52o62-84i97-116o |
| contig55_gene_29 | conserved hypothetical transmembrane protein | 1 | i45-64o |
| contig55_gene_41 | transposase | 1 | o5-24i |
| contig55_gene_43 | conserved hypothetical protein | 4 | i9-31o41-63i138-157o192-214i |
| | ion transport protein | | * The topology is given as the position of the transmembrane helices separated by 'i' if the loop is on the inside or 'o' if it is on the outside. The example 'i7-29o44-66i87-109o' means that it starts on the inside, has a predicted TMH at position 7 to 29, the outside, then a TMH at position 44-66 etc. |

FIG. 9B-178

**ORFs containing membrane-spanning domains identified from *M. ruminantium*: nucleotide sequences**

| ORF | SEQ ID No. | Nucleotide sequence |
|---|---|---|
| Contig40_gene_28 | 1003 | atgaaagttgaaataatgattatagggatcttgctgctttcaaacttcctatatcatcatgaggatggaaatcctattgtgcagtatgtagcata tattgcctcattgcttgtcataattttagggttcttttaa |
| Contig40_gene_32 | 1004 | atggaaaaatcagtcatactccttgctgcagttgtatcctttgtcactgcattccttgcaaacatctctgtagctttgcccttaatagcaaggga gcttgcaatgagcaatatcattcaaaattgggtagccacaatctaccttcttccaattgccatgctttccatccctttaggaaagcttacaagca agcatggcctaaacaagtcattgcttgcaggaataatccttacaataataggagtaatcatagcctgcttttcaatcaacagtgaacttctactt ctatcaagggtaatccaaggaatcggaaccgctttaatcaatgtcgcttcaatggcattaatcgtttcagcagttaacccagaaacccggggaca ggcattgggactgaacattgctggagtctatataggactctcatcagcccctgtaatcggaggccttgtcatctaccaccttggctggcagagca tattctatataatgctaatcccactaatattctcagcctacctgtcatggtcactcaaggatgaatggacaatgtatgacggtccaatagacata actggatctatcatattttcaataggtattcttctagtaatctatggattcaccatagtaaacacatggcttggcatagttctattgataattgg tttactattattaattgcctttgcttattttgaacttagggtcaataatcctgtctttgatgtgagactctttaagaattctaggttctcctctt caaatattgcatccttgattagttatactgcaacttttgtaatcacatacatcttaacttatcattttcagtatattatgggctttgactctaaa ttttcaggcatgttattaatagtaacacctgtcatgatggcaattctagcacccctatcaggcaggctatcagataggatagatcctcaaaagct tgcagcaataggcatgggttttgtaacagtggcactaacaatcctatgcttcctaaacgaatcaaccccattat |
| Contig40_gene_33 | 1005 | atgaattcaaaacaaaaacattaataatcctaagtctaagcctaatattgctagcatccatagccgcagtatctgcagttgattacaccctaac aaatgcagatatggactatgtggttaagtctaacggattattgcatgtccatgaggcaatcacatatgactttgacagcagccccaatggtgtct atagagacataccccttaaaagcggccagtccatagagaatctggaggtttatgttgacggggcctatgcagagtaccagatcattccaaaagga agcggtgagaggataaaggtatatctctatacagactcctcaaaaagccataagctatcttcagactctgtaataaccgtccattatgtctatga catgccaaaggttgtaaagatctataacgatattggagagctccagtataaggtatggggtgatgaatgggacgaagaccttgaaaaccttcaat ccacaatcacattcccagatgatgaggagcttcagttctggatcaacccatacttcagcaatgctaaggccagatgggcagaggaccacctgaag atacactcagactttgtaggagacggcaaatatgttgaggcaagggcattgattccgttaagcgaattcgattccaatgcagaatatgcacagca tataaacaagaacggaaaggatgagataatcaagatacaggacgatgacaagaaatctcaagagggcttcaaatccttattctcaatattaaata aggtattggtagtgctatgctttattccaggactcatctaccttaagttcggaagggagccaaagacaacatatgatgcaatatatgagcatgag cctcctacagatgaccctccagcctatgtgaatggtatgataggctcagggctaaaggatgtaggcagtctaaatcaggaagctttccaagctac aataatggaccttatcaacagaggcaagatgggtgtatcctcagaggaagacactgaatttacaaagacaacct |
| Contig40_gene_36 | 1006 | atgaacaataagcaaaaaacattagcaatcctcattctactcgctattgttttaacaagcatttcagcagcatctgcagtggattataaaatcac aaatgcagatgtccacttggatgtggaagacaatgggatattgcatgtcagcgaaaacataacatatcttttcaaaagcgacggacatggtgtct atagggtcataccccctaaaggcagatgagaagatgagctatctgacagtggatgttgacggctcatactttgaatataatatcattaaccgttca ggggaaaaggaagtaagggtatacttatataaggataaggatttaactgattacggagtaagcgaaggctctacagtcactctaaagcttgacta ttatatggaaaatgttgtaaagctattcagagatacaggactcctagaatacaagctctggggtgaggaatgggaccaaggagttgagcatctaa acgcaaaggtcacattcccaaatgatgaggagattgaatattggattaatgacgattccggaaagacagaatcaagcttctcaggagacacacta tatgtaaagggctcagacattcctaagggagattatgtggaagcaagagttctcattccattaggtgaatttgattttgatgcagattatgctct acattacaatcatgatgcctctgatgaggtcaaaaagcagcaagaggattttcaaaaaaagcagcaatactttaacaccattggcaatctattaa |

FIG. 9B-179

| | | |
|---|---|---|
| | | acgttatatatggcattcttatcctcacgccttagccatatatctcaaatacggcaggagcagcaaaggtgtcaagtgatgccatatatgagcat<br>gagcctccaacagatgactctccagcctttgtaaatgcaatgcattgatgatgagtgattgagatgttgaaaggttgataagaaagtttccaagc<br>cacaataatgatctcattaacagagacaagcttgaatgaaatagcatatacaaataagaaaagacctgtgt |
| Contig40_<br>gene_37 | 1007 | atgaatcttaaacaaaagcaattatcatgtctcatactctaatgtctctgccattcagcaagcgactataaggaagctatatgga<br>ttatgtcatatgaacgtaaacgaaaacggttcgtttgttcacgtcaacgaaagcttacatatcaaatgtatctccagagtctgaaataagccttc<br>ccctctatcatggcaccaatgcaagcattgaaaatatccatattaggtcaacgatctcttgttgcctatgaccctcaagaaagggacactcta<br>gatgagctagtcatacatcctaagtcttcagattatgatgactctgaaagcacaggcacatatctcttgatgtgaagtcgaatatggccata<br>tgaaaatgccgtaaagtctataatgacgtagggcatgaatactcatcatcatttaatgggttctttaggaatggcccata<br>taagaatcaagttccaggcactcaggagcatgacaactgtcatatttgaagtattcccaatggcaaagcagtgccaatatgctcagcatattgattctgacgg<br>atgaccaatagccagcctgcgaaagactcattcgattgaagtatcccaattcagatagttcaacatactgataaaaatctttgtaatcatcgcattca<br>tccttccggttgcaatatacctgaaataatgcggaacccttaggagcgtcggtcggtagtgaacaagcaaagcaaatcatgagccctgtattcaaacacagatgatcctcca<br>ttctttgtaaatgcaataatgggcggaacctttagggacgtcggctagtgataacaagacatatctcttgtgcaaatcaacag<br>gggaaagctatctgttgaaactgaaatcaatgaaaagaacaagcaaagcaaagacaatctcttgtgcaaatcaacag |
| Contig40_<br>gene_42 | 1008 | atgaatataacagaaaatcagtctgataatgtctgataatgtgaaaaaatattaacaaagtcatttttgtctttattttggagcttgctctttacagccctgt<br>aatgtatgcattgatgtccactgtaacagagtatgccagctctataggttccactgcactattgcaggtcttgtatctgaatatgtattcg<br>gtgggctttgtttgttcaagaatatattcagcaatgtcattgcaatgtcattgcaattgcttattgagaagaattggaagaccttagcctaatatccttcaatctccttttagca<br>tgcatattgtactttcttgtgcacatgcgattgcttattgtgagaggcttcgccttctttcgagaggctttcgaaaaacgcttagtcgacaatgtctttatgctgaaccactatcgctgtaggattagtccat<br>gactattgcaagttcaattctttcctatgatatctggggctctcgggcctctgtatcgggctctctcgtatcgatgtcagtaggctttctcattcatagcacagaatctatagatgcaaa<br>atatcagcggattcttcttctatgatatctggggctctcgggcctctgtatcgatgtcagtaggctttctcattcatagcacagaatctatagatgcaaa<br>cttgatatagaaagtatcatccagatgaaaagataaaataatgaaaagagcttcattgaaaagatatttgaaatagatagtgctatcccgtctccatttcttccatttctttaatctattcagtc<br>cccaatcaaaaacaaagaaaatactctcattctataggcttcttatgcagtggaactgacctgttgccatctcccgtctccatttcctttaatctattcagtc<br>ttgatatgtgtccatcaagccaattgcaggtaagatccaggtcaggataaaatgggataagatcatctgtgtaatggcatagttgcacagtcaatagg<br>atcctagttgcatcaagccaattgcaggtaagatccaggataacaattttatatctgtgctgtaatcggcttaggttttg<br>actcttccttatagctttatgctccatctgacatctgacataacaattttatatctgtgctgtatgcggcttaggttttg |
| Contig40_<br>gene_43 | 1009 | atgggagagaaagcacaatgggatagtccctttcatttatattgctatgattggagcagctgtaggcttgaaacatatggcgtttcagcta<br>tgtactatactctaacgagagaggatcattcttcattccttatttgtagcaatcatgaagtaatcctttttaatactagttgtg<br>ttggattcagcttaagattcgttcacgaatatcttaagaaataatcttaagaaataatagatgaaggcttgaaatagtagcctgatactgattctttttgtattt<br>atagttgtaattttattatgtcatatactgagttggatgtataatgttggcaaaggggatccctttaattcctacaaccatatcccttttgctcagtgtgggagtggacactgcagctta<br>ctttacaaatacagttgaggcagtgcagattggacaaggagatgaattgttgacaaggagatggaaaggttcaaaagtattgatcccatctgaaatatatattgatctgacatatgggaataatcgta<br>tatggttatatccatagggatgttgacaaggagatgttgacagttgattgctctgttctgttcgtcctaactgcaagctatcttccagagtcctcaaggctcactgaca<br>ttctattcaatcacagatcatctctcattaagcatggccaggcaatgggcaggcaatgcccttacatatgcaacccttacatatgcaagctatctcttcaagagtcctcaaggctcactgaca<br>agcatttgcacagatcagttgtgcctcaaattcattgtttgaaatattcacagcatttgaaatattcacagcatttgaagtctttccatattggatcatgtcagtcatattctga<br>atgtattgatagttgtgcctcaaattcattgtttgaaatattcacagcatttgaaatattcacagcatttgagtctttccatattggatacatgtcatattcgta<br>atggccttaaacaattgttacagaaggacaggcttgtatttgtttattgtttccgcttagcttcttccgagcctatgctaa |

FIG. 9B-180

| | | |
|---|---|---|
| Contig40_gene_47 | 1010 | atgaagaaataaagaaatgaactgaaattaaatttgcaattatcatgtttgtttttggcagttcttcattttcottgctctgatacottatotg cggagatgggaagagatcatcgcttatcttttggaagcatatcggatttattccaatagatatcottcattgtagcattggttcttgaagagatca tgggaagaagagcatgaagccattttagaagagatagacatgcttatgggtacattcttctgagattggaaatgattaattgcagaatta agcaaggccaatgtaaattaaggctaacactgatgatttaaagcctattaaaggctattaaatcatgaacgatataaagattatgataataaactaaaagaattgaa aacaatcctgtagacttttaaggccaatactctaacttgctccagaggaaagggaagattcttaaacagaatccagagcttattggttgaaaacagagaat ttttagtaaatcttatcaataaccctaacttgctctgagaaaagatgaattccatcacttctgcttgcatccatcactctgcttgcacttgactgtgaagagcttgca agaaggtgaattaactgacataaaggatgctgatttcaatcacttgaatggtgatatgaaaaggtttattccaaattggttatgaatgggt ttattatttaaaataccttaataagcattatctcttatgatatctottgctatacgtaccaatccgttgatagcgaagcagatgttcatgtga ctgaataa |
| Contig40_gene_60 | 1011 | atgatagaggaattagtaactaacatgtctctataacgaaagcggagcttcagcggccagctctccaatatttacaataacaattctagtctttacaat cttgctccttataggcattatatattttgtcttttgaatcggcattcttataatcaatccagttctaatcgttctaattgccgttttaacag ctattgcaactgtgggactgttattctaatgtcatgctaaacctgcatcattgtaataataatgtgggttgtcttttggcaag gaggaaggtttccttgtaggtgccttacaagcattgtttcaggcatattcagtgacagtcgcattcgaatcctatggggatcttacggct acttatggagcaagtgcaggatactttggcttctcattcaggaaccgcattgccattgactactcataatcattgcattgtcacctatgacttg gatactgataatttcagctatatttcagctcttctattcaggaaccgcattgacgtttcagcttgttatgcgtattgttagtcgcatatattgacagagctaagttacaagagctaagattaaatatctgtctaatcc agctcaagtgatgaaagcattgacttaactaattaa |
| Contig40_gene_62 | 1012 | atgaacttacagctcatccaggctattatgcttactatatttttatatggttctcttgcttcatttttagcgatccttcattttgtatt gagttttagcttttgattcttatctcctctgaatcgacaggggcacatagatatatctttcaacgatctcttcaacgattcttcatcacctatgagcaattgcatat tgattataattctaaatcccctcattgcacttctcaatgataattgtaatgcattaagtctttctcatcattataatagtcagttctgttcctatcaggagatgcttatatctttc gggatattgatgtcattgaacatcatccaatgaattgttaatgaagcagtatgagacctctcagatggcattaaggccattgaggttcaaaagctgaata taaaagcttcaatatcaaagaaacaacattgaaggcaatcttctgaagacaatcttctgacaggcattatgagacaatatttctctcagat gaaataattcaaaagaagattcagactcgatttagagcaatcgactcaaacatcaagcctgacatcggttccgattcaaggtctt caagaagataaagtcctctaaaaggttccaatcaattccacagtgaaagcccgtggatacaactccaatgagcgaacaagctatcttctcatacaagctctgacagtcggacttgcagac aagagtccatgtttacagccaagtcaatgcacagtcatagcattatgcacaatatatgtgataatgccatgataaacattatccttaatctatcatc ctctcattcagcgattcaccatttaacattatccattaaacacatttattttgcatttatagttatttgcattatttacattgtatgcatttagtatcttataccttatctatc |
| Contig40_gene_74 | 1013 | atgatggattaatctctgaataatatctaattccattcattataatgtcttgctttgctttcaatgtattctctcactcgtactatgtgg aaggcgtgaaataatttccattattgcaataggatttgttctcggtgctattggccgatacttcttattatcctatgtatcaggacagtccct atgtattgggcaatctccaggattggtttttacaatgaaagtgagataataaacctgaacattccatcagacgatatcagtgatgtcactgaa aagattctaaatcaaaatggggtcaattcagtaagcactaatgatttgagcttacaacagctcgataaatatgaaacgaaaacatatattga tagctatcttaagaatgattctcagatagagcgctataactgttggagtgagctcggaattcgccgatttgttcacattaagttaatgtaatgcaaagcca cattggagatcccttgttacttgcttccataactgtttaaggacaatcattataagtctcagtagaagcctgttcaggataccattcattattcataatctatgatca tctgctccagattatgttgtaatgtcattacaggcattacaaggcatattggtgttggtgctattgcttgtcaggcatatatgcattgcagttggtatt |

FIG. 9B-181

| | | |
|---|---|---|
| | | taagagcctttagagaggggggataa |
| Contig40_<br>gene_76 | 1014 | atgtctggcttcattatgtctattcttacactcttattggctaactattatgatctgaagtatgggattattccaaataagttaagtgtttcct<br>tatgacattttgggattcctaataaatgtattgatttaattgtccttaattgtccttaataatcgattgtacgcaatatttttatgtatcttatgtttaatt<br>ttattatctcattgtcctatggaaaatatcctttgggagtgagaccigtgaagctattctgttcaataggtttcacttccctttatagat<br>atttctgaatcatttctatctatatgcagcatcttaaatactcttaaatactcttatctccaagatcttttcactactgataaa<br>ttcaatcttattgtcattcgttcattccgttcattctattactgttcttgttttataagttgcttaaggaaaacaagctgaacttgatgtagaggattattcatagc<br>atatgaaattgctcataaaagaactgtcaacaaagacagtattataaatgaacgacctgaagatgagagaggaatgattgagaggattattattcaatagc<br>ttgagctatttaacttgatggaagagctgactgaagagtgctacaatctaaaagcaagcaatcttaataaactttccaatttaaaatca<br>gtcatcttcaatgcaggtctgacaaggatgacattaaactaatcaattttgcatatatgaaacttaataaacttccaatttaaaatcaa<br>aatggagttccttttgtccctcttgactgtaggatattgttcttggtgcttcgtgattggtgttttaattcaacaataatctaa |
| Contig40_<br>gene_127 | 1015 | atgagtgataaaatgaatggggcagcaatctatcattgttcttcttgcgatgtaggttctgctgctgtcgacttgaaacatatggaacatatgagatccgta<br>tgtattatacagcaacgtggaggggcattcaatcatccttccaaaggccattgatggaattccattttaatattgaatatgcg<br>ttggatatattcaaatcatcctttccaaaggccatggatggatggcaattagctccaaagcagaatatctaggatgctgctcctcctactcagtattc<br>atcatcatgatatactattcatgcatactgggatggatggcgaatctgtcagcgaatctgtcagatctaggatatcttcttaaggatgggagcagatccaaacacatt<br>cttttgcaagcacattgctccagtcaaggactttggaagagggcctttggacaatgttgagcaagatcttttcacccgattgagaactcttttacacatatggaactttgcctttgccttttgcttttataatcatgatagattt<br>tcgtttggtacattcccatacccttgcctgcgcaatgaaaatatatctcccttagcctgcgcttgcaaattgcgcttgcaaattgctattgttttatgcttgcattgttttataacagatatcgtttttagacttcaacatatggat<br>gcggcattcggccagataaatattctcccttgcctgcttgcaaattgcgctttgcaaattgcgcttgcaaattgcaaagctataacagaaggagacattatta<br>caaatacactggcagacccttgtaactcaagtacagacccttgtaactcaagtcatctttcaagtctataaacgtattggacaatatcaaactattggacaatatcatatgt<br>ggaacagcggtggcagacccttgtaactcaagtacagacccttgtaactcaagtcatctttcaagtctataaacgtattggacaatatgcatatgt<br>aatcgacctttattcttcataacagtctatcttgcaggcttacaagcatcctatcaactattgagccattgt |
| Contig40_<br>gene_131 | 1016 | atgatagacagtttagatatgcattaaatgaattgcagtttctattaaagatgagagaaacctgaaaatccaaatgattgttatgatgcttgt<br>tataatagccggatttctttttaaagatactaaccagagaaatgactgttgataaggacaatgactagcaaaatgactagcagaatgactagcaggagct<br>ctgcattgaaaatgctatagactacaccagagaaatgactgttgataaggacaatgactagcagaatgactagcagaatgactagcagaagctgcaggagct<br>gttcttgtaattgcaattgcatctgcgattgttgattaattattttattccgaaagttctcttattgctttaa |
| Contig40_<br>gene_145 | 1017 | gtgattggagagagaaagcctaagatgtccttaagatgtcctgagatgcattgcctcttgttctttttctgctaattgaaataggattgcattgtttgt<br>cagtttattcattggagtatttattgatatgataggataggataggataggatgatgttttga |
| Contig40_<br>gene_168 | 1018 | atgtagtacttagtgcaggagatactgcatggtgctcattgcaacaatcctgttctttcttgcaacaatcctgttctttcttaatgagcatcccgaagtagctttcttttatag<br>tggtttaacaaaacgtaaaaatgtcttaaatacaatgtcttaagctcaacatgtttcgacttttcatttctcatagcaagcataatatgggttgtatatggatacc<br>catttgccttgagatgtcagtataagcggtttgcagtataagcggtttgcaatcaacctgctcattcttcatgagcgaatcggaatcggaatcttacagaacc<br>atcctacaatattgttcattgttcattgttcattaacctttgccgtgccgttccaatcctttaccgattgccactggtatggaggagatccttatgcagaggttt<br>agcatgatagtcttcatcattgcttgttcattgcttgttacgattgccactggtatggaggagatccttatgccactggtatggaggagatccttatgcagaggtt<br>ccctgacttgcaggaggtacagttgtacatatctgttgcagcttaaccttgttcaacagcacttatcaatgcggatgccttaaccgtgcaaccgtgaaacagcacttat<br>ctttgccacacaacttaggatatccttgtatcaaacgttgcagcttgcaacagcacttatcacttggtaattcactggtaattcactgttaaagtcggaaaagc<br>cgaacttgcagcatcagcttatccttgtatcaaacgttgcagcttgcaacagcacttatcacttggtaattcactgttaaagtcggaaaagc<br>caaccatgttagggcaatcacccggtggagtggctgacttgttgcaataccccctgcagcaggattcgttgattgtcgcagcagtattgcatt |

FIG. 9B-182

| | | |
|---|---|---|
| Contig40_gene_173 | 1019 | ggttttgtaaccacattcgtatcctactttgcaatctattacttaagacaagattcggctacgacgatgctttgatgtatttgagttcacgg<br>tctttcagtgtatttgggagcaattgcaaccggtatatttgcagttccagcagtcggaggtgcagcaggtttgc |
| Contig40_gene_174 | 1020 | atgaacatctttaaatctgccacttaatatcctcagtcattgaagccctatcatggaaatgaatctcattcttgcctcacttatcctaagctgtgtagtcaatga<br>caagagagaccttatatcgttcattgaacacctatcaacgttttcatcagcctttcctctcatgactgactgcatacttacaatgc<br>tcattgcagccgcaagaaaactatcttgtcatgagattaagctaagctccagattgccataatcttatcataacactgatcatatgtccc<br>ctaattaatacaatggccttatcggacttcttcctatgattgaatacagcttacaatctgcaactattatcttaagacaatcaaatggat<br>aaggtgcattcattgtaaatgtattgataatgtgatgatgaaagaggccaatacaatagactcttcagccaataattaa<br>taatcgattcatatcttttagtaaagctaatcaaggatgaaaagagggcaatacaatagactcttcagccaataattaa |
| Contig40_gene_175 | 1021 | atgtctgatgatttatatagaagagctgaaagaaaagtgatgaaaaaatgaggattttataagcattatatagctatattgtgtaaacat<br>acttcttttgccataaaatgcaataacatcctcgcacatcctcgcaaatgttgttgttctattggtaactatcttttgggaataggcattgtaattcactttt<br>taaaacattttgtcttgactggaaaacttgaagacaaccagaggaacacatgatttcaaaaggaaatgattcaaaaggaaatgaaaaaataa |
| Contig40_gene_175 | 1021 | atgaaaagacttttttaagctagtlgaaaaalatlcLLLaLaalcatcataaLgcaallgcaaLLgcagLLgLcLtttccaggctcattcgattg<br>ggttatggagagtttatgtggtatcaacatcataaacattctacttggtatcaacatctactgaatggtaccacttgaagatggtggtaccacttgaagatagaattttg<br>taaactattcaaaaggccattgacagttgcctctgcctctcctgtcctgtcctggacagttcaggcaaccgcttccgatgttatcacattcctgcaaggggga<br>tcttgcacttcagtatcctgtgatatgtttcattcaattgttcagattcgattctcttgtaattcttccaatagctattgcagttcgcaggtcttgtgcagagttcagttctattacaagtttccagactc<br>cattcaatcctgtgatatgtttcattcaatcggatgattatatctgcctgcagcgatcgtcgcagacttgcctgcaataatcgtcctttaggattgtgataggatatctctctgaataacagccatctct<br>tgcctcatctgtggtgaccatagacatcagcaatagagcttgcctgcaatatggcaaaactttttgagcttcaatccaagtccatatagacatgtatgcaaaagccctgtaatagcatcctttctctgaataacagccatctct<br>gcaactgttccagagcctgtattcagtagagaaaactttttgcattattagagacaatatagcactttttggcattttccatatatttcactgatgaggaata<br>g |
| Contig40_gene_176 | 1022 | ttgaacgaagagcattacaataagcagctattaaggattatcaagaaagcactgattagtgtttatgatcatagagaagagatagattatga<br>tgaagatgttgatataagtcttttgtgatgtcctgattgtgcgatgacaataacgaccatgatgacgatcatcaccatcatcatcatg<br>accatgaccataacaccatgaacacagtcatgatcatgagcatgacatctatagtcatgagcatgagcatgagcagcatgagcagcatgagcagcatggccacgagcat<br>gggatgagcatgagcatgagcacagtagcatgatcacgaccatgaccatgcagtgagcatgagcatgagcatgggatggcatgagcatggatgagcatgagcatgagcatgagcatgagcagcatagtca<br>tgaccatgagcatgagctgaggaatgaacatgagcatgtggatgcgttgcgatgatgacatgagcatgattagaagaacatgagcatgatgagcatgagcatgagcatgagcatgacc<br>atagtcacgaccatcatgagcatgaacatgaccatgagcatgaccatgatcacgagcatcatcatagcatgagcacagtcatgagcatgagcacatgagcatgagcatgacc<br>gaagaacattctcatgatgaccatgaccatcagccatcaccgaccatgaccatgatcatgagcagcatcatcagcgatcatcagcgatcatcatccacga<br>catcctgactgtgcagatgatgatgatgatgctggccaagagaactcctgcgaggatgtggagagagaaagccactcactcatatcaacagaccatctca<br>catgcctgagcattcacagagaactcctgcgaggatgtggagagagaaagccactcactcatcatatcaacagaccatctca<br>atcatgtttcagtgaatattgtttatcacagacaatcctgcataacaattgtcacaataatctacatgcttgg<br>agcacttatagcaggctatgagatagcaatcctgcataacaagtcgctctgtcacgtcacactgtcggtcctg |
| Contig40_gene_183 | 1023 | atgagtgaagttattactcctaatgtgggctaaatattcaaatattcaaataaacaaagccctgccagcaagaaaagcaatgattcctactataa<br>aaatgtcctttttgatagaaggtcccatgaagtcccaatgtaggcaaaagcctgacattcaataagctgactgaatgacagctatgtttccaattatcctgaa<br>ccactgtggatatcgatgaggcaattcacatatgaaacagcagttcatataacaagaccctccaggcttcatatatgactaacaataacc |

FIG. 9B-183

| | |
|---|---|
| | gaagaggaacgtgtagccaagctattgtgtattggacaaagctttgacttgactgtagttgtgtgatgcaaagaacatagaaagtcaataga<br>ccttaccttgcagctattatagatgccggaaaggaagttatccttgtattgaacatgatgatgagcttgagaaaatgggtcaactgtagatgccc<br>cgtcattgtcccatgagcttgaattccagttgtgcttactgcagctgccaaaccgaggattgaagtgactgaagcatacaatcgtaaactat<br>gattcaatagaagaatcaaatctttaagcgagtctaagacattgttgatgtcgattatgaaggtcaattgaaatagcaatctctgagattcaaag<br>aaatatcaaaggaattatccggtttccaaaagtatctgcagttctctttcgagttctctcttgaaggtgatgaggacagcgaagacttctaatgaaagtg<br>aggattgggataatctatccagtcattggtgctcaaaagcaaaattcgaccagcctgtcaagtatctgactaagttgcttgcttgcagactat<br>gcaaaacatataaagtcaagtttacaacataagcagcgtaaacattcaggataccgacagccttggagaaaagctaagcagaatcatgatcca<br>tccattctatggtcttatcatactggctgtgttctttttgttcttgccttatcttattgtaggagttcttgtg |
| Contig40_<br>gene_188 | 1024 | atgattgtgaatcttgtcattcttgtccatccttactcttagcgatagttgttatttcattacaccctccatattttgatttctattttaaat<br>tccggcaaatgcttgattgttcctaatgatgcaattaaaaatagtagagcaataggtgctcttactttattttagtcattattgtagcatatt<br>ttgcaattagtgagatgttagggcctatggttattggtattgatgttcttacaaatatgtatgtcaacgttatgcatgttaatctactcctagtacaagtgatatcagt<br>gctgctctaatggctattgatggtattgatttgattattatgcattatcaatatattttgtggagcattgttcttaaacgaacaagtagtattgatga<br>tgttgatgatgaagatgcatttaa |
| Contig40_<br>gene_215 | 1025 | atggcttcttgtaatataggaaaaaaattcatagagctatataggtacctttttcctagtgtcttcctcggtacgaggctgctctgttgtaactttt<br>actatttctgatagcgtaactccaggaaaagctggcatcggtaactcaggtcttggagattggatagctattgcattaggtttaa<br>ctgtaattgcatgtatctactacattgtagccaagtaattggagtgggatatcttcctgcttgattgccgaatgtataggtatagtagcagtgctgtaac<br>gcaattgacagtatctactacattgtagccaagtaattggagtgggatatcttcctgcttgattgccgaatgtataggtatagtagcagctgtaac<br>aattggaggattaggtgctaccgctccaagtatgggagtggaagcagaaacctggatttgcaaggtattcaatcggatgactgtagcagctgtaatcatcgttttaggt<br>ttgtaatggcgttgctgttgatgaaaaggcagaaacctggatttcctttacttggtcctcttatcgtgtggtagcagccaattctgggattcttccc<br>gcattcaccggtgctcttcaatcaacctgcacgtaccttttggtctttacttgatgacaccttgcttggcgaaccaattctgggattcttccc<br>gattacttagttgtcctatagtaggtgcagtcctttgcagcaatattatatgatacttagctaaaggcaatgatgcatgtcattgccacaac<br>cttcttttgaagaatag |
| Contig40_<br>gene_218 | 1026 | gtgtatctgggaagctcattgcattcattgaacttggtgccgatatggttgccggattgcattgatgttgt<br>aggttggtctatgtgttgcaattgcaattatcatcaggccaccggtaagaatggatcaataagctattgcctcctgtaattgtaggtcctatga<br>ttatggttattggctttgtttggccccctaccgctattcaggaaatagggtattgaaggtatcccaatcaataacattattgtggctctt<br>gcagcattcctgaccactgctgtaatagcaatccgtgtaatagaatggactttgaaggtattccttcctcattggtatttgtagcatatgtcgt<br>tgcagcgttattaggtatggtggttgactttttacaatagttccgattgctcttgctcttgaagttccagagttcctatgatcgttataaactacagct<br>tcaatcctacacgctcttcttactaagtccgattgctcttacaagtccgattgctcttacaatgcagtgtaacaatgtttggcctacttttgggacaacaagtatttgggaaatcattgga<br>cgtgacttgatccaggacccggattgaacaagaccctggtgacggtcttgctacctttttgcagcgctctggtggccagctaacac<br>acttacggtgaaaacactctgtttgtaggtcttacaagattgcatcaatctattgttatcggtgttgcagttatcttttgcat<br>tccggacacttgactgcacttcttgcgcactactaaccctgttatgcagggtggctattcttcttacgattcattgcagtaaatggt<br>gtaaagctcttgattcaagaggaagttgattcaacaagttgatttcaatttcgagttcgatggctgcaccatgttggtttaggttggagctac<br>cttgtccgttcgttgctcaaggtgactatctgtgtcaatttctgtatgctcttgctcttgctatgtgtgaatcc |
| Contig40_<br>gene_220 | 1027 | gtgtatcaaagcttttttataatgatttgaacttgaccaagaaggatgcatatctgctgacttgactgtgtttttcaattctctatacagt<br>ccacctaatcgatgtaaactatacccttaacttaaatcagacccattgtcatttaattaacgttagtctatgctgaatgcagggccata<br>tagagaactattcctatgaatgttcctaacaccctgtcgtatcattcctgacatcactctcttttagaatgggaatagtgacaagatagcaata |

FIG. 9B-184

| | | |
|---|---|---|
| | | atgatcgttagcggagtcataagcatcctgttgaattggattgtacctactattaaaaccaagttcaatgaggtctactccttttcggctg catcctatttgcaagcttcccacatagtcctccacaatctgggcgtgggaggcatagacattccagtatgccttcagtatgcgcttcagcatcctat tcatgtattgcagttgcagttgacaaaaacctaaataactacatccaactttcattccaactgactttctcaatcttgtattatcaatatgcattattc ataatacctatattgttcttatcaaaagcgaagagttaaatacattccagaattcttgtgcattaagcgataggatgagcttaagatagt tattaagaactatataaaagcgaagagttaaatacattccagaattcttgtgcattaagcgataggatgagcttaagatagt ggtcatatgagctaatctgacattcctgacacaatctcaagagtctctaaacgattcaacagtgcaaaagcagcgagagtcattttactat aacgataagaagttctatataagaaatctctacactttcttcttcattgatcattcctgcaatcatagcaat cggaacagtgttcaacttgcaaacataatcagaagaagaataacccctatgtgtgagagattacaagacac |
| Contig40_<br>gene_230 | 1028 | atggcagctataatatgtccaagatgtggaaaaatgaatgatggaagcttagattctgcatctattgtggaacttacttgatgattataatga agaagacaacaatgactaatctcttttttataagatcaatgaccaatgtgggagcctgcaagaaacaagtggtcagattaaatgaaatgccag atatctccaaaaaacctaaacataggcttgccatactcttttaggatccgtttgcaatattaggcggacttataggttttgtcttgcaatttat ctaattacaagaaaagataagaatgccagaaggcatgactaatccaattggttattctattaataagaatatgcttaatagtgttttaatctt aaatggacaattggatataaaatatggtttagatcctttcaatgcctttcaatatgactcgcatgaataatcaattatataattccagccaaatgaatg ttagcgggtctaatatctcaagttatttgcttttaa |
| Contig40_<br>gene_246 | 1029 | atggaagaattatattattgattatattagttttatatattagtcaattcttgcctatattaagctataagaagcatatgaaccttt tataatatctgaaattgatgttttaaccttagttttagctagtcgatgttttattattaaaccatggcttgattgattgttagttctg taattcttctcaccatagcattcttctgcattgctcttgcaatagaggaagaaggccaggatatgtgtagaaaggaaactgcaatcgaattttggtt gcagtaattgtctgatttttaacatctgatggagtctatattttaaattttag |
| Contig40_<br>gene_247 | 1030 | atgaatcaatggctcagatttaatcaatgtagtaatagcttcctgcaggtagtctttttattagtttccatagaaaagtcatgcgagagt ccaattaaggccaggaccctccattattcaatatcctattgcatcaatgaactcagagttcctttaagaaacaagcttccctaaaactgcttcaatgc catttatgtggaattacagtaagatttgggttaccggagtattgtgtccggttgtccggttgcaaggttccttaatgataatattc ggtatctatgcaatccataagattgtagagcataatgcaggcataatgcaggtcctcatcaggttcccctacggtaagctaagctgtgtaaggctgtattctc agcggcaggagaattgcctctcttgcagttaatgtctgttgctttgtcttcctctaactgaaccatggatattggtgaatataatcaagcag caaacgtccttgcatttaaaatccctcttgaaccgagcattcggttgctatgcttagaggatatataatgttttcagatgcaatcgcttgtatatcttt aaagaaaagaaatcattacaggatttgaaaccgagatcttttcacgagtggtgatatgtgttattacaggattatca gctatggctcttcttgacatatattcttgcaaccaatccttcttgcaaccaatctgtaatggctcaaatatccagttatttgcgttatttgttgttcaattatcatgattatt atttaa |
| Contig40_<br>gene_249 | 1031 | atgcttatagagaactttaggtggagacttttttaggaacaatccctcttggagatattgttctatacttaaaccgctccatatattcctgtttgt tactatacttctattacagttctaagctctaatagcaatcagtcgtactgaaacacaagttgaagctatgttggctcacttgatgagataaggttgcag tgggactgaagagttaagcatagaagattcttagcgataatatgtgtatagcaacagcgggagctatgattacaggggacctttaacttc accctatttatgccttgattgttcaatattggtttgtcatatattggcagctgtaaagcaagtggaagctcttaaattcagcttatcagtcagtgatt gatttgccatgatgtgtgattgctgattgccattgtggtgagcaggcatatattgctcaatattggcagcttgtttagcttgcaacgattc cagcaaatcctatgatgatatttggagcacttgttatgcaggctgcggtgaaagcgtagcctccattcttttgcaagcaggcagag atgtttagaactccaggatcccattctccattcttgttcttctatgttcctatgcaattgtcctgtttcatttattaattttaatttttattgacttactatatt gtaa |

FIG. 9B-185

| | | |
|---|---|---|
| Contig40_gene_250 | 1032 | atggtagcaagcgtaatccctcaagttgttccggctttctatagtcaatgtataccacagcctatatggtggtttgattgtagctttattgg<br>cttgattggagtggcaatggcagagagacattcagattcttattctaacagatatagttggattggctatgctatcgtcgtagctgcagttg<br>gaactgacttgtctgaagcattgatccttccagtctgtagttgaattggcagagtcatgcaatttcagagatattgatatctcgtgagatg<br>agaaaggctgataaagatacctcatttagcccaatgccttagatattgagattggagtatatgagaactgctccaactgctcattgcttct<br>aatcggatacggcatattcctgtctgttttaccggcgtgacagtagctgcgagggtatcgtcatttatgtactagtagaaaggttagaggat<br>tgccgatatttgttcttgatgcgtaggagcaacagtattcctgcggtttatggatcaatcgtttcatattcttctcatccttccgcaa<br>tactgcttttaagcctattccttgcagcttaggactttttattaaggttgcttcaaagatcgattgattggaatacttatgagagaggaata<br>tggaagaaaataa |
| Contig40_gene_253 | 1033 | atgttgaatttataaatatagaaacaatatcaatgcttaatgattataggtgccattgagttgtctttcttaaaaacattgataaaat<br>tattatgtttcagttctgaagcagttgtcttttagctatcgttagctttaaatacttgatgtgcctcctaactgcagttctcgatccat<br>tatccatcattgtattcttacttgctttaattaaaatcaataaagtgccaagtctaattagaggactattccacttagacaagcttaatata<br>agcactgaaaatctagaagaaaaatcattagataaaaactctgaaggagcaaataa |
| Contig40_gene_254 | 1034 | atgtatatagaaatcataggagttattacaatttaatgcttaagagcagtaataactaaaaacagagcagaaaagttacttacataaatgt<br>aataggtttctgtgtatctgctatattgcttattacattgcatttaaaactacattggcttgtattagctgcagctttctcattcctctacaatcg<br>gttcaaatgcaattgcttatatagcttaaagattttggaagatgagataagctagtgataagggatgaagaaaaggatgaagagaattaa |
| Contig40_gene_255 | 1035 | atggatatgatcattggaataatattagctgcagttatctcttggatttgtgatttttgtagtttgtgacacattcctaggcttgcctgaggctccagg<br>agttaagggtgcagagaactgttggctattcaatcaataggagctctttaggaaggaaaggagattggctcaaggagaaacatttatgttctccag<br>atgcttcagcaggaaccttgatagcagcaatagcgcggaacctgcgagcattgacatgccatgacacactattgatattcatttctcatttgttgaatcgaagttga<br>aggctatgtgcagatccaggatgtgattgcaatatttacaattcaaggaattcatcatcctacaagttccagattgcttggaaagattgctaagtcct<br>gatgttcatttgcgaatgtgtactaatatgaataa |
| Contig40_gene_256 | 1036 | gtggctatagtagttgcagtcattgcagttttgccttttgccttaagattgccacttcttccgaaaggccaatcaggttctcttgactactagcgcact<br>gtttccaaccctattttgctataggaaatattgcaatattttcattggcaatatgttatcgaatgcgtctcatcttaagcgtgattg<br>tcggattagcttccgctctcttgtaaagtatgatgatttgactacatattgaagctcctcaaatcgaagacggggaatgtctaa |
| Contig40_gene_268 | 1037 | atgaaatcgatgaattactattacttacttcattaattcattattgcagttgttgcatttaataaaatattttcatggctcttgcctatcttgtaat<br>attggctgtagccctatgtaattattatttattattattactgaaaacaatgcataa |
| Contig40_gene_273 | 1038 | gtgaaaaaataataagaaagcattacggaatacattccctaatgattttcttcctattgaagagattaaatcattaatgcagctttatttt<br>tttgctcataatactgctattctacttgcatcatgaactcttcttttaacaattttgaataagcgggaattgatctttatcaattcattaa<br>tagacattatcttatcagtattctagtgacaatattatgacggctctacaagagcaagataatagcatatttcctttgcctattgtatcc<br>atatctatatcctcttgaggatcattaagatatagatattggatttcatccgcatcctatcgtctatcggttgtgatttctctataacaa<br>gttatagaattatacagaaaagaaataacctggaaaaacaattctaatcctgaaataagaaatcaacaatagtcttag<br>aaaacaaaatcctatagatgcagtggcaatggtacaagtcaatgcaatgccgcttaggagacagcgaaggaggagtcttg<br>actagcgtattcctagctgggaggatataatttcaggagtcgctacgccacattcaggaatatcattcatagaaactctagaaagaa<br>atttaggaatatgaaactaagataagacaatcttgagataagttgataattgttgaatctcaaaggagaatgaagaat |
| Contig40_ | 1039 | atgtcatttttaacattaatattaaaaatcctttaggaggcaaaagcgagcatacttgcaatcataggattgaatcggtatagccacaat |

FIG. 9B-186

| | | |
|---|---|---|
| gene_282 | | catcgcattgggagcaattaccgacggaatgattgcaagtgcagatgacacactgcatgccggagatgtgatttacagtaagcgaagatag<br>agagcacatcacaaatggctacattcgtacaagcaccattgatgaggattatatagataagataacgcaatgtaacggtaaagatgct<br>ataggaatgtatatgacccgtccttatgacaacaaattcccatattccccatattttgctgtttgtaggattgatcagaagactatcagtttcgacttgac<br>aattacagaagacgatgtatataaaacgacactaacgagatagtgattgtgatctatgagaattgcatctgaaatgaagaggagttgaaccaca<br>tcacacttgatgacaagaaatcaagattgtggaatctcatctatatcaagttaatgatgagaggatgttgataagtcagagataccga<br>caaaaactctcaaaggtgaaggcaagatcagttccatcattatccgacttggaatcattcaagttaatgactaagaacatgatagacatgttgaacgagcaagctagca<br>caaatatgagacaatctgacaacaataagctcattatccgacttggaatcataaacactgcttacaagtgtatttgaaggacaagggagcttgtgtcttaaag<br>tatccctcttgcaatcatcataattggagctgtcggaatcataaacactgcttacaagtcattacaattgttgccggcataatcgggtccattgtagg<br>gcagtgtgatggtctgacgaaaagattctattaatgattgtaggtgaatcaatagtcattacaattgttgccggcataatcgggtccattgtagg<br>agtcattggagtggaactccttgcagcgtctaagataatgcagcttctaaaccctgtatattcagttgacatat |
| Contig40_<br>gene_284 | 1040 | atgcaaaccaataaaaacatcgaatcaatcatggagaaccctaaaaggccataaatagattgacctatcccacaatccttccatgtctttaat<br>gtttgcaaataacttaatagacagcatgtgggttagcgggttagcggagctgaacctcttgcagctcttgatctccattgtatctgtgta<br>ttattggctttgaagtggagttggagcaggcgcaaattcacttattcccgtttgattggtgctaagcgttatgatgagtctaacaatgctgca<br>atccatagtattataagctcttatcgttcaatcatcattcccattattgaatgttcttcttagatgactgctgtcgttcagttttgagcggg<br>gtctgttttgattatgcaatgactatgtatgtgcttagtggtatgcaatcctaaacattacattctttgatcctattttcattatatttaattgg<br>cagaagggacattagaagggccacagtgcctttagtggttaatgcaatctgcttatgtccacactgttgtccaactctgttatcctgttgtctgtaaagagggatacattcat<br>ggagtcaaaggctgctatcgtgctactttcatagcaaaatgaaattatataaggagatctcttttgtaagcatccctgcaagcttgaagagcttatctatt<br>ctattgtagctatctgctttaattctccattgaatcctctacaatacagttgcaggcatagctcacggggctagaactatgcaatatgcctagaaggcatagctcacgggctagaactatgcaacaat<br>gcttttcttccatgcatttcctaagcttcactcctacaattacattgataatatgcatatattctttgtatttgcctatccga<br>caattattcgactttcctaagcttcactcctacaattacattgataatatgcatatattctttgtatttgcctatccga |
| Contig40_<br>gene_287 | 1041 | atgtttggtaaagataaaaagagaactctaatgaaaaagtgttgtatgaaggcaaccaaatttgatagtttattcaagagcatatcattgc<br>agtgatttacttggctattttctattttctcttctattcaactgcatttcctctattcaactgcaatcatattggaaacatgcaagtctatattgatagaatcaaccaaattgc<br>cattgactcgctatttgcaattgcagagttatcgttgaaacagagttatcgttgaaaaggcattatattaataagaattacatgccttacacttagagatgtaagtcg<br>tatacaattactgaaagcagagttatcgttgaaaaggcattatattaataagaattacatgccttttaacactattcagatgtaagtcg<br>ttctcaaagcattttaggaaaaagcattctcagtaggcacaattaccttagcacaactcatcaagtcacaactcaagaacatgtcattaaggatgtctcaa<br>acctaaaaagattgaagatttaattttgagaatatgggacaactcatcaagtcacaactcatatgacgattcctatgcaatccatat<br>aataacagttataalaacccataacaaccatgtatgaagatcttgatgaagctttaaagtcaaaatgggacttaagcaataagcctaactc<br>tgataaaaggttcattataatcgtatgaagatcttgatgaagctttgatgtcgagtaacaattataataagaacaattcaattgaccctaac<br>gaaaagctaagaattccagagaaattataagcagaatcctaattataataatcgcaacaactatgattttgctatgattgattatgaatctgctataa<br>tataacaggaactctaattataagcagaatcctaattataataatcgcaacaactatgattttgctatgattgattatgaatctgctataa<br>tcaaagatccaaaagagccctcaaggcaataggggctattcaaaaggaatgcaaatcaatcaatacagagacgatt |
| Contig40_<br>gene_290 | 1042 | atggcaacttttaaagatttgcaatgaaaagactcaatgaaactcggttgggtagaaaagaagtacctgaatgtgacctatgtgacgctattat<br>taaccaacttgtgtatctccatgtactttccgatattcacacagtatggaagtgcatcggtgacagagacatgatcttaggtcacgaag<br>ctgttggtgaagtagttgaagtaggtagcatgctcaaaaattcaaactgcgaccgtaattgttccagctatcaccctgactggacgat<br>gaagcagctcaaagaggattccctcacaacaccgaacctctcggtgttgaagttctccaacttcaaagacgggtattcggtgaagatt |

FIG. 9B-187

| | | |
|---|---|---|
| | | ccacgtaaacatggctgacgcaaacttaacttcatccctgacgattatccgacgaaggtcatgtatgttaaccgacatggtcactggta |
| | | tgatgggatccgaaaacgctaacattccattagytgaactgtgaactgtacttgttattgtattggtgcaglaggtcttctgctatlgctggtgctaaa |
| | | tgttaggtgcaggtagattattcgctgcagtaccegtcctattctgtcgagttgctaaaaatacggtgcaaccgcataatcaactacaa |
| | | aacggacctatcgatgaacaagtaagagaacttaccgatggtgcaggtagactctgtagttattgcaggtgtaacttagaaacacatggg |
| | | ctgaagcaattaaatctgcaaaagcaggaggaacttgtatccagtatccaatgtaaactacttaagtggtgctgacaatgtattaatccacgtagaatgg |
| | | ggttgcgtatgtcaaacatcaacattacaaacgattatgtcctggtgagcagtaagaagcttgctgaaagaagactgctgatcttgcattatgcggcag |
| | | acaagaccctgaattattagttaccccacaaattcaaagtcttgaaaaaatcgaagatgcattgctcttgatga |
| Contig40_gene_301 | 1043 | ttgctaaagcagatcattagaaaatttacaagcaaatatagagattctgtttaggcatactttggagttttttcaatcctttaatcacaat |
| | | ggccctattgacagcgattttttcatcagtcttgcaagaaaacattgaaaattcctgttactctaacaggccgttgcgtattgattttt |
| | | tcaatagcggaactaaaatagctatgaactcacttaagaaaacagcggtatttaaataagatatttgttccagatatgtcattggga |
| | | ggaatcttttctgaattcattaacttttcaatgagtatgagtgctattgtattgtaactagagcgcctttccatttatacagacattgaat |
| | | ttttcagtcattccaatagccatccatctgattttagaagtgactgaacacttcccatactctgtaccaaattacagagtatatgtcat |
| | | atttatataagatatttatgtgttatatagctcaatcagagagtttgtgcgatatttgctctatatgctgtggttcatgtatacaagcagtatatgaa |
| | | ttaaatccgattttatgtgtattataattggagtaatcatatttaagaaatcatattcagagagtttgtcatgtatgaagaattcaacaaaagttgtgatgctataccttttaac |
| | | ttcaatagtaatcttttataattggagtaatcatattaagaaatacagaattacattagagtttataa |
| Contig40_gene_326 | 1044 | atgggatatattttaacagatttattttaaggaagcttggttttatcctccagcaatatagttaattattcttggagtattgctaacaataag |
| | | caagttccaaatgttctatcaagtttgagtagatgcagttgagtagtgcagttgagtgtcgattttcagttcattgtatgtttcttttgtagttcattattca |
| | | tggacggctattcattgctgtaattaagatggactttcaatgtatcacacaattctcttgcttgtgacattatgaaaatttcattgacggcgtt |
| | | aagtgtatgggtattgaaaatatacttactattatccacacaatgagcttttaatgaatagccaggtaatgcaattcctcaggaatatattgcaa |
| | | tatcttaggttatcggtaaatcagagctttcaattgttgcaattgataaatgcaattctttttacaacattagttgtctctcttcttacaacattggcttgcagatagct |
| | | ctttcctactagcttcaatgaaggaataaacttcaaagcaatccaggcaatcatatgccaatgccaatatatattatcctatgtatattat |
| | | aatatgacagcttcaatgaaggaataaacttcaattgtatggcgttgcagctattccatattggaattatattgcttaatttgcttttgctc |
| | | atgtttccttatcatatttgccatatcaattccattgttatgtacactggtttattgttattgtatactacaagacagaagatataatgatag |
| | | cattattctgttgtgtaaacagttcacttggtttattgtcacttggtttattgatatactacaagacagaagatataatgatag |
| Contig40_gene_338 | 1045 | atgaagactttaaatattacaagaataagatattctcatatgcatttgctcataataatactttttaatcgttttctgctcttat |
| | | tttcattattcctatgtttgtaggatatttctattcagatcagataactccatacattcagcctgttgatacctttgagaaacattagaa |
| | | atggaactgtgacttttatcaacaaagtccctattgcaaaatgggcaaatgggctaaattctataatgttgaagtggctaaacttgaagtgcaaacttgaagtgatcctgggctattta |
| | | ggattgtcgttttgagatttcagcaatcattattgcaacaacagtgatttattattgcaacaacagtgatttgttgattctatcatgtgctgaacttgtgctgaacctatgctcttttaactcttcttcctatgg |
| | | aatatttgagatttcagcaatcattattgcaacaacagtgatttgttgattctatcatcatttgtgctgaacttgtgctaacctttaaatcctctttaaaagcatggtcat |
| | | attactcctatactgtatattttatattgctttgcgtattcgtatttgtattcgtaatttcttatcttctattaattgcagcattcattgaagcaaatattaccattccttttgcata |
| | | agaattaaggaatctttaataatcttttatctatgtttagtgaagcgttgggataagcctgattaa |
| | | ttggatttgctcctgttgttgggataagcctgattaa |
| Contig40_gene_356 | 1046 | atggctaagagaaatttagtgaagcttaggcaagatagtcacacttttaaaaaaggatttttactgatgtatttaccaaaaatccagttgtgcc |
| | | tattgtattgctgtgctattatatttacctcttatatgctcttataaacatccaagcatgttgggatccatacgataatacagaaatattg |
| | | agatgcagtgcaaacttggataatgaacaatggatgaacactggatatggaagaagacaacataaatgttgtaatgaatgggaatagagataggagctgaaggaaatgat |
| | | gatttctattggctctttgtaaatgaaaacgaacgcgagagggttaaaaatgaacctattattccgaataatcattccgaagattgcag |

FIG. 9B-188

| | | |
|---|---|---|
| | | taaagcattaagtcaatcactactgatgaccctcattctgctgaattgaatatattgtcaatagaaaatccatgcatctaagttaa<br>gcgattccgctgtctcaagtgcaaaggcgtctataataagatcaatgctaagattgtacagttattaatgtggtggcctattcaaagttaggcgagcttcag<br>tctgcattgtctcaagtgcaggtcaggtgaaatccgctgtcatctggtgctgtcaaattgtcttccgatccgtcaggtcaattctggcgctttctcaagtgaa<br>gtcaggctcaaatcaggtgaaatccgctgcaaatcagttcaatcaggtggtgctgaagttcatcccagcagtgaggagataaagtccatgcat<br>ctgaggtcaagtcagggcagttggattcctctgttgatgttgacaaattgccgagtgatgactgaagcatgtgtaaacagttccaagcaattggctaa<br>agttctgctaagcagtcggcgggatcttcaagtcaactggcaaacggttctgtcagcttgcaaatggctctgtcc<br>tgcaagttccaatctggcgcggatcttcaagtcaactggcaaacggttctgtcagcttgcaaatggctctgtcc |
| Contig40_gene_366 | 1047 | ttgaccgtttccttcctatttgtcaatggagcagcatctgtttgctgaattgatcaattgataaggcagtaacaaaatctatattatggc<br>agttatatttaacgtatgtcttaattggttcttattccaatgttttagttattgatgagaggcaatatccactgtattaagtgtgaaatatttat<br>tatcattttaa |
| Contig40_gene_368 | 1048 | atgaatcaaattaaatccatttttaaaaatactggttggttatctgtttcacaagtgataacaagcatttgtgcattcctatggaccataatcat<br>agcccgatacctgggagtatctgattatggcattgtctcatttgcagttctcttcactggcttcactggccttatggaatagtgatgatttggaataagca<br>catacatcactcgtgaaattgcgaaacataaagattaagtaagaactctcatttaacaatatcttttattaagcttatattagccattatcta<br>tttattttaagtgattgatttttgtatgtcatggatactctcatttgaaaaagtaaaatcaagccatagagctatattaatagcagtttttataag<br>tatgctacttttttaaatgagttttccagcctttggcgttatatccatgcttgcctacactgttgcatatcaatattttcatatgttta<br>tcatatgttaaaacatttcagcgacctcatttgacaattggataacaaattttcataaggaagtaataatcaatcaattcttgacttacaaa<br>cttcttctattctatttatttcacaacattttatttgttgttattaatattttaatgagcaacagactttaagtctgcatacaaca<br>taataaatgttttcttacaacattttaaaatattggttgttattaatattcctatcagcatagcatagtttcttctatcagaagaccagtgtggatcttat<br>ttacagcaaccaatactcacttgctcaactccagtccaaatactattatctgaccagtttcattcctatttgtca |
| Contig40_gene_378 | 1049 | atgaccataagtcccaagagaatattatattttagatgaagttcgctcacttgcaatcatgctcgtagtcattgcaaggctgtttc<br>atataactacaatagttggctgtttctgcagcggagtattttccctaactcgtataggagtccctccttcttttacagtaaggatctcttctt<br>taactagaaaatatgaggtaaaaagtttttagaaagcgattcaaacgtatgtctgcctttctctctgataataatatatagttgcc<br>ggagtgctgattggcattggcagttttatctattgaccttacattcgaatatgtgtaaacactgcattggtgtgaaactgcactgttctgtttatttg<br>gtcacttattgagttatctattatacacattcggattcttcacaataagaagtttaagtattcctcaaatgaaataaactttagagtcatcttaactgatt<br>taatactgtcctattgggtcttcatttcacaataagaagtttaagtattcagatagaagatgttgctatcggatgcgtcttgtttatgtcggaat<br>ctgcgacacttgcaaaaatctatctaagggtcttggagacttcccttgcaccgatagacttcttgacatatgtgtaataatgaaacaa<br>tagggctattcattgcattcattgcaagcaccaaatggataaaaggaaagatgcaagaattga |
| Contig40_gene_379 | 1050 | atgcaagaaattgaatttagggaaaccaaattaggtgaagtgattgttctatttgcatcatgcctttgaatctatttctcacattatattct<br>tatgagatatattatgtatatgattttagctccaataagaaaaacacatgcactgtttggcttcctgtaagctcaataatcataataggat<br>taagttggcttttaatacgtaatgagcaagattccatatgtaagaatagctagtgggttaaatag |
| Contig40_gene_387 | 1051 | atgaaatcggagaaattattactgattcttttaaagtatcctattaataacattaaagcttaataattacatagtcctggtatcgttgcagg<br>tcttgtactcgtattaaccggcgttggcgtcggagcaggtgcaatagcagcagccactgaattgttgaattattgaattatta<br>tattcttcctatatctattattaatctatactttataatctttaggatacgaattagatgttataacctttggtattgaagaagatgacgctcctgaattc |

FIG. 9B-189

| | | |
|---|---|---|
| | | gctagacaaataactaatggtattaaatgtacattacttgcttcatttacatgttaatcccaactatcattatgatatttatcatacctcaa<br>tcaaacttaggttaattgtaggaataatattttatcatagcagcattcgcttttattaatggctcaatgcagattagctcaacacagacagct<br>taggtgaagcattaaatattccagaagcaattacaaaagtgggaattataaaataataagcagtattccttatttttagttatcctaa<br>ggccttgtcgtatcattttattttagtttattgtagtttaggcacatatattggagctatttatctgtatttcacaatcta<br>cctagccttgtagtcttcagagctagtggattatcacactaa |
| Contig40_<br>gene_401 | 1052 | atggcgcaaatcaaatgcccagactgtgcaaagaacaagaagatacaaataaattctgtaaaaattgtggagctaatctatcaaatgtaaaagc<br>agaagaagtaaaattagacctagacgctgctcaaagctccaactgaagagaaatagacttaaacactgctccaactgaagatgaatcagatgctt<br>ctgaagttaaagaaactcctaaagctcctgtggaaaataaaagtgcacaaatgaattatgcacagtgtgacatgaataatgaaagttctgtccaaga<br>tgcggacaatccacagctccatagttccatatgaagctaaaccaagtgaaaataaatgacaaacctgtcatcctgtgaactaa<br>agtaactacagaaagttctgtccaaattgcggagtaaaatagaaggaaataatgtcccaaacagaaacgctcaacagaaatattgtagaa<br>attgtgaaatccgattgtatcctaaagctgaaatatgtccaaaatgtgcgtaagacaatgactgtgttaaaagaactttattctctctt<br>attctatcacttatattccaggcctgttatacatgctcttattacagtttacgtatggcttacgatgcatatagcactacaattgcttaaaataatg<br>tttaacaattttgtaattggagttcttattatacagtcttattacagtttacgtatggcttacgatgcatatagcactacaattgcttaaaataatg<br>gagagtatgttgaagataaactcttctaa |
| Contig40_<br>gene_428 | 1053 | atgcaaagaaagacattcacgttttgatgaattgtaaaattcttaggaaatgtgataagaggtttaggcaaacaccagtaatag<br>gataagccattagaagtgatcagaaaataagaattattacagaagacttccagaaagattaagattaagagcttcaagagcttgaacca<br>catttatcaaatttggcaattgtaagcacaaggctgatttggttgagagaacctgatttcacagctccacatgatgatacct<br>cctattgacttgagggaattaaggtaattatcgaagatcttgaaggaaatctaaaagattttacagagtttcagaagttcaagaaatcgttg<br>tacagttcaatgctcaagtccagtgataacttcctgctaatgaattgacatgtagacccttaagcatctaatctccgctgtcgttaaggaa<br>aaactgacttgacatataatccttcatatgaagatgattgacaatgaactgacatcagacattaagagaaatctcattcatatgataagatcat<br>tttgacaggtccattcataagaagactagatgattttctgaaagataggactcttgactagttcgtcgtcatgctgtagaaagtcttaacaaatcctgacgatttcctgacaacctcat<br>tgttccaactatatttatccaatatcattcattacagatgacaattccatatgtgatgacattatatgaagataaggactcttgactagttctgaaggtcttgatgaaaatgaatattctaa<br>atccaaatatataatttcttcattacagatgacaattccatatgtgatggagttcttgatgaaacttcagacaagatttggc<br>cctgaaatatttgtttctcaaatcgtgacattgatgggctaatcaatcagttaattttatatgaatatctaa<br>tgaattgatgatttgtttctcaaatcgtgacattgatgggctaatcaatcagttaattttatatgaatatctaa |
| Contig40_<br>gene_433 | 1054 | atgaagcatagattaaatttagataataaaactaaatagaacaatatttacttttgtgaagaaatattttaaagtatgttcttgaattgacattcattca<br>attagcatcctatgatttaaaaactataagaacaatactttatagacatttttaaatctcgaagcatattttataaattttcagaa<br>ttttaaacgactgaatcaatctttaaacagaatctttaaacagaataatctcgcaaatactttaaacagaaatatgtcagatcaagtttataaattttcagaa<br>ataactctgaaaaactttatataagtttaaacagaatataaaagcaaagaacatctcagaaaaattggatcaagttcagatcgatgc<br>gactccagtgactttgatatctaattctaaagcgactgttgtgatgatctagtctcagaatccgtttgcatttaatccattctgagctcaaatgat<br>aaggctattatattgatttaaagcgactgtttgattgatctagaaacctgttgcatttaatccattctgagctcaaatgat<br>gcaggactttttgaagagatttagaaaatggcaagtataaaacttcaaaaaagaacgaataatcagaaaagagaataatcaggaacaagaatt<br>taaaactaccaaatagcaattgaaccatttttaaaccaataaggggcaaatcgaagatttttcaattattgaacaaggcttgaatatgagagaatccacaaatata<br>cctatccattagcgtattttaaacaaaccaataaggggcaaatcgaagatttttcaattattgaacaaggcttgaatatgagagaatccacaaatata<br>tcatgggagaatttaaacaatcccatta |

FIG. 9B-190

| | | |
|---|---|---|
| Contig40_gene_465 | 1055 | atggcattagaacttatgaatttattgatttccatctaggagctgttatttatgtgctaactaagtggtcttgcttt<br>tgaggggaactccaattgatgcggagcgaattaccgagatgggaatagaataattggaaacgagtaacatgaaggttgcattaatgaa<br>ccattattgaacctcttgttgtgtgtcttatattaggattcttaaggcatatgtactatcggcgcttaatcggtgatgcagttggaagttt<br>gtttatgaagcctatctctgtcttgtcttatattaggattcttaatgcaattcaattcggcgcttattcggtgatgcagttggaagttcataaaagag<br>aatgaatcttcaaagtgccaagctgctccgataatgatcagtagtttgtcttggagccctatatttagcctttagttgttagaataa<br>gttggagcttttttattataatttgtctgcttagtatttcattcattaagtagtaatacatatagcatattgcttggaattaaggatgttttgg<br>tattaa |
| Contig40_gene_471 | 1056 | atgtttgaattacaaaaaacgaattaagagatttagtgattgcatttatcgtgctttcaattgctttgcaatagcaaatgtcaaattcgattt<br>gcatgcattcattctaccattgtagttgttggataaggtgttgttggataggtagggattcctattgcatgagctgacacaaatgtgcaataaat<br>acggttacaaagcggaattaaattatggcctataggattattaagtgcacttattacatcactatagggatgggtatttgcactgcctgtgaa<br>gccaagattacagcagagaatatgtgaagagaccactggaaagattgcaatcgctgaccgatggctaatataggcttgattgctatttat<br>agtaatagcagctataacatatccattgcctttctatacacttttgaattaattttacctagtcagcactgttggcttctctctgtaaacgcat<br>tttagctacattaacattgtgccttctcatatttgttataggctaactaaagtgatgaagtggagtgttaaagcatttattgttcattgcaata<br>gctgcaatcatgatgttatcatctatgtttataggctaactaaagtgaaatatgattttaatgcttataggaagttaa |
| Contig40_gene_475 | 1057 | ttgggccttattacaacaggtatggaacagtccgttcaaacaacaagtgctgcagaaggtactgtaaccaatataacctcaattgg<br>tgcaggactattgattccagtctggtgatcgaacagatatgtctttcatatggaaaccaataatgtttcacgaacgcgggattttgtctgccacagatcaaaact<br>ttgttgatatggcctcatcgaacgatatgtcttcatatggaatcctctacaaggctttatgaataatcgggcagacctttgaccttgaaggaata<br>aaagacataaatgaagcttttttgaagagaaattgaattgaatttgtaggggttcgaaaatgtgctgcaagcaatggcataatatgtctatggagataa<br>tattccgcttagagacaggtgctgaaggaaatggtaatcaggttatatgtcaagacagatgaaggagtaaacacactgttgtggcagatcgatagag<br>gataaatatgagaatctgacaacaataaccagcgaagagatgtctcagatgcgtaaatacaatggtcatgtctgttttatgagagaactaaggaaataggtgttttaagt<br>ttccgctcttgcaattattgtaggtgcaataggaagattctaaagatgcttcaggctgatggagatacagatcgaaagatgttgctttgggatacagtccaagcacttcagtattgtaggctcagcattcggt<br>ctgtaggatggaaaagcagaagagattctaaagatgcttcaggctgatggagatacagtcgaagatgttgctttgggatacagtccaagcacttcagtattgtaggctcagcattcggt<br>attctcattgcagaggtcggtgcaggaggaattatcctgcttatatgaagcaagtaaattagctcctcacagaagcattga<br>cattgttgttgatgaggattgattggaggaattatcctgcttatatgaagcaagtaaattagctcctcacagaagcattga |
| Contig40_gene_481 | 1058 | atgattaagaagaaaactaatgataaggagcaatggtttatataccgtgcaaatcttaggacaagacacttgtaattattggacttgcagcatt<br>gattatcatatcagcattttcgtatgcaaggacatatttcataaggacatcctacaaattcgcttcagctaatcagatgcctcccttgaacacctttt<br>tcggtacagattggatggaaggaacattgttccaaagaaccattgccggttgccgtgtctgattaaggcattatgtaggttctcatgcatcagttctcagt<br>accatcattctccaagtgctagagattgcttcaattcatttataagttgcagatgaggctgtgtgctgatcagtttgctgctgactttcggttcattcc<br>acacattctaatcattattcgttcaatatgtttggtggaaggaatacattgcatttagtgcctagtctacacactgacacctctg<br>caaggtctaaggtctgatctgaagtcaagatttgaagacaagaagaaataaggagatttgatagctata<br>aagcacatttcccattgatctatctccaaataattgtagagtaatattagctcctcaatgttgaatcaatgcactactcttctt<br>aggttcggtgctccacctcagtgtattgcatttgatcttattgcatttgacctgctgatactggtgtggcattct<br>accctgtctatcctgctgatagttgtattgcatttgacctgctgatactgggtttgaaaagctcctcaatcctgaaacagcacaagttaa |
| Contig40_gene_482 | 1059 | atgaataaacaaaatagcaaaatatttgttggaattagtacgatttgtcgtattaatgattgtcgttgcaatatttagttttgtattatt<br>agatttatccctattgacccagttaatgcttatttaaaagtgctgcagtaactgaagctcaaagatcaaagagcaatttacagcaatttggtacca |

FIG. 9B-191

| | | |
|---|---|---|
| | | atgttccattgcctgagaagattttccattgcttatggatttgcttcaaggaaatctggaacttcctaatctaccgtagaccagttatgat<br>gttattattgacaaattcatgcttctctgcattgatgacaatatcctgatttaaggcggtatcatcggtttgtttgttaggagttgtagccgg<br>taaaacaaagttcctgattgataaggcagtgaagttctactgttcccaataggattcggagttcctattggaggtaaggatacgatgcaaccttattgatgggcaacc<br>tggtattctctgttatctggatggttcccaatggcttgtgggcatatacggttgaacattggaggagtacgatgcaaccttattgatgggcaacc<br>agcggttcttcctacgcctgacattaagcctgtaggctttggccactgcatgtggaacatgaaaatatattgcttccgcaatcacactc<br>ctatgtatgtttgcaaagtccagagggaaaaggctggcactgcatgtggaacatgaaaatatattgcttccgcaatcacactc<br>aattcttatcattcagtgagctcttcgagggctgtcatgtggaacaggtattctcatacctgaataggacagactgcagtgcagcggt<br>cttcaaacagacgttccactatttttaggaattgtggtcataagtgcaatatttgtatttgtaggtaacttgcttgcagatattcttattactt<br>catagatccaagaattaaggagaatgagttcaatgattaa |
| Contig40_gene_487 | 1060 | |
| | | atggaatttttaaaattaaaaagatcaaaaatatttttattaagcgttcttatggctgtgcttccagccctctgatgtacatagcaacatttgc<br>tttgatgaagtccaggcctttgacgctctatttaccaatgtaaacatgtatatgtctgtattgttgctgttcttatctttgcaatcattatgg<br>catatctctttgaaggaatacaatgatgctaccattccaatttcaagggaaagttcctgctgtcttgtttctc<br>ttgttccttttggctttgcttctgtcacagcttctcatttcaaatctcttatttgcaaatctctttgacattctctccgtttgtattattcattgtttgttacaa<br>cttgcaatgtaacagcttgcacagcttcatcattcagcttcttgttttgcacattctctccgtttgtattattcattgtttgttacaa<br>atatgtgcctgctatgttgcgagcagtctagcagaatagcagaatatgcctattgcctatgcattgctactttcatagttgaatagt<br>cattcttactttactttactaaaaggacgttcctctttag |
| Contig40_gene_495 | 1061 | |
| | | atgaaaatcataaagcttaattgccatactattactttgcacttttatcacttgctcttatctcctttaatgaatagaacaaggagttga<br>acttaaaggaggatcacttgctgaactgacaagttcaacaagcgtaaatgacctgaaagtcaattaactaaagaattgaatacaaaca<br>acataaaagtgacaagcaatgcgaaataaggtactgtagaaataaggccatagatgaaag<br>gcaaggtgatcagctagctataatgatgagtaggtcctgttttatctgaagaggcaatggacaaatatatatcgcatgtcatttttattat<br>ggcagttactgtttttattgtattagagagcctgtacctgtaggtcatctgtaggtgcattatgttgatatactcattgtctcttggagta<br>tgtccattcttcacatacccttgtcaattgcatctgtaggtcatctgtaggtgcattatgttgatatactcattgtctcttactaca<br>agacttcttaaaagaaggaggaaagaactgttgatgaagagctagaaacgctatgcacacaggttgacatgcctgtcagctatcgctgcaat<br>gggaattctttacatagtcactgtaattatcatgcctgaagacttatattgatgagagcgatatttcagcagttctggttattggataatggaagata<br>ttctttcaacctgcttatgaacctgaaatccaaatctaaaagaagatgcaagtcgaatccaaatcattaaggacagattaaagttaaaggtccaaggatgatga<br>agtcaatgagtctaaatccaaatctgaagactcttcaaagattctgaatctaaagactcttccaatgacatagacagtt |
| Contig40_gene_496 | 1062 | |
| | | atggctagtaatttatccaaattcttcaaggatgacaagtaatcatcctaattatttgcctcataatcagtatcagtatgtcttccttgg<br>agtagaacaaggacttgacctaaaggcggttcctccatcaattgaacatcctgtaaacgactctacaatgaagttgtcacctctg<br>tactgacaaaaggcttaacttatatgttgtaaccgatggttgtaaccaggaagaccagtgcatagttgagatgcaactgt<br>ccgaagagggtgagcgctgattggtagctgaggttgtaaccaggtatttgaagcaaaaatagcaatacacagaagcagtctagtaggcagtgacttgcaactgt<br>agaccgctcgtttgttgaactgctgagaatgcaagtccatttacattaactaactacagaagagctaagaaattgcagcgttgcaaggaa<br>aagcggaacatgaagttacaggtggtaatgtatctttgacgaagatgtgccgaagatgtgaacagcaaagcagaatgaagttcactgaagttcactgtcc<br>actgaagttcaggttacaggtggtaatgtatcttgacgaagatgtgccgaagatgtgaacagcaaagcagaatgaagttcactgtcc<br>gtaaagattcaactgtagttcaactgttcccaatacagttcccagtagttaggtcagtagttaggtcagtcagtttgcacaaggaggtta |

FIG. 9B-192

| | | |
|---|---|---|
| Contig40_gene_498 | 1063 | ttggtatttcagcagtgtatatcagatatagaagagccttcctagctatcctattacttcattacaacattatctgagataatcattatcta<br>gggtcgcttcaataatccattgaacatagaccttgcagcgattgcaggtttgattgcatctgtaggtactgggttagaccagatcatcat<br>tacggatgaggtgctgcaccacgacgatgaaaacaccaggcatgaagaacaagaactcaaatgaatgtgaaga |
| Contig40_gene_510 | 1064 | atgtgggagatggttttgcctattttgctgtcattttatctaatacgatttatatatttgtaccaagtcaactccaggaatgtgaatgcctt<br>tgaacattgatgataactatataactgcagctatttaactgctatcatctttgtatttctgtaaagctgagaatgttatgtggaactttctcatgttaattgacatctgttgtgcttgaatagctattgtgggattgagctgcttatatttttgcattcgtgccgttgaagtcagttctgcttccaattgtcttcaatattgactgcttgttcttgacttctgggcgattcttatggtgagaatataacacttaagcagcttggcgcatattattttgctgttgattattttgattaatatggttaa |
| Contig40_gene_514 | 1065 | ttgcaagaggcaaacgaagacatagatttaatcgtaaaccatccaaagcaggcaattaacaagcttgcacttccaatcattttcagcaacttcttcatgggttaaacaatatcatagatggaatatggtgctgattaggatccaattcctttgcagcagttggcttgactggtgtgctgattccccatggggcctgtgtgctgtcggtgtatcgtgcttggtgctgtgctgtgctgtgtttcctttttgtgttgttttaaatctctcctattgctgatgatgtgatgatgtgcacaaccattgatccaagcctttctttcttcttcattcctctgaccttcaacctgtcctttaaatattctagttttttcactttgtctgattttgatttatgtgcattcaacatgtatgttaaaattagatttaacatgtcctatggtgagacaatatgtgtctctttttcatatccatttcttctttgtcactgtgtagtcatgcttcctagaagcatgttatagagaatattcaccctaaaccatctctcatcagtgatctttatggttacgccaagtttcctagcagtcatactgatggttcttcagattgctggttgatctctttgttattcttttgctgtatatttgatatatcttatagtgtcatgctgttgcttgcttgcttttcagccagtaatagtatagtgttgatttgcgaggatcttcatcagtggtcaagaattcacattcaattttctcatattttatgttcagcacattcctttaaagtgtagccctaagggtttttaattcttaaatatgtcatatcaccctttcagtgaatatattcaagagccaatgatagtactacaactttgttctggcaatgacgaccaaaccctcccacacatcttccttcctttgatgccaaaggatcagcagcaggccgttaaatcacctgacaactgattttccaggccagcatttcttaagttaaccataatcaaccacactatacactttaatccaacagcaataa |
| Contig40_gene_526 | 1066 | atggaagagtccaaactagattgaaggagttgaatcaattcttaggagacccttaagaaagccatatgaaattatcaattcattaataattcactatttatcacaagcctctatagtgtcatagatgccgttcatagatgcgttgggatgtcctctcttggtgccgatgcatgcctattgcctggtgctgtggctttgtaagtccaatatgccctaatgggaattggtttggagcaggagcaaccctcgcaatatccaatatccttctttcctatattcctatatttcctatattggttattctatccaattcattatacggacaatggtcagttcatgcaatactatagattatgcaatgatgagtcattcaagctcattgcctctatcttaaatgatctatctttatatggcatcaaatactatagattatgcaatgatgagtcattcaatgatctcagcctattcaggatctagtcatgcaagctatgagcacatatagggagcattgaagaccttcattcctttgttgataaggtattaaggataaacagtagacatcttaaggtaggtttccagcaagcttggagcttgttaacaatgcctctctttgcagcacttttccctcttttaactgttgcgcatcaacagtgcttgcagtttattctacaggatgaggttgttaacaatgcctctctttgcagcacttttccctcttttaactgttgcgcatcaacagtgcttgcagtttattctacaggatgagg |

FIG. 9B-193

| | | |
|---|---|---|
| Contig40_gene_535 | 1067 | gttgttacaattgcaacaactcctatgcttgctgctgtaggaactgcttgtattcagtggtagctgcaattatgggctagcctgccaattatgggctagaaatatgaggacat tttacttgccataggtattcaatgaagattgcggttctatttgctttattgcagcgatagttgtctatgtat gtggctggtttaaatctgattgatagtgttattgagtcccatgataatccttacgagctcctacgagctctgatgcaggactctacttactttactttaaaacaag aggagtccagataagatattttagagtgcacagatcctaaagaatccttacgagcctcactatatgcaggaaggcagcatatctcccttcaggcaatgcttg tctccacagcttcaaggtgaggacatcatctgcattcatggaaatactcatcatatgtctctgtgctctctgctctatatgcctgcaggggtcttctatgagtcc atgtgtatcatcggagcatcatctgtcttcataagacataattgctctgctctttttgcgtattctcctgctacatatgcctaggattcaatatgc tgcatattatatagagcatgtctcaacattcatgaatatccgttctctatcatccaagcataactcgattatcataggtgcctgccattatc tttgctccttaaccttcagtcaacattcatggaggggaaaaaggattgtcagtgtcacaagcacacttgttccggttatggagtttcctatgtcatcatatgttt acctgctactgcttacttggagtggaaaaggattgtcagtgtcacaagcacacttgttccggttatggagtttcctatgtcatcatatgttt gattgtgattcttttcaacattcaaacatgccagttgtttcttaatctttaggatgcatttgatttcagtccatcacgcttcagctctgcagatgta tcccaccctgcaaaacagggattggctcagacactctgtatatatgacaccctttcttctttgtacagcctctgcatgatgctcagatgta tggagtggtaaggatggcggcgtttccggtgctccatatgtccaaaacgccatttcatctgtctttggatgga |
| Contig40_gene_541 | 1068 | atgaatgttttttagaagtttttatagatattctaagcgataggacagttaatgaaagaggatattttcttcaaataaggcactctttgccttatt tcttcctctgcttgtttgaacaagcttagaattttgcgtagttctgccgactcaagtcttgccgactcagttatggtggagtagcgattcaggg tgtccttagttgactttttagttcagctgctctatattagcttcgtcttatattgctcacgggagctgttatgcggcagtaccttgaaac gatgccaggagaagcatgtgacgctctctttgtgttacaacattcttaacacttcaagcattattcaagctatatgctattcaattccat gccatttaatcaatctcactacaactctgagcagcagcaatattgtcaatgaacaagcaaacctccatccttaacactgtctcagagcactataattgctctgtgcatttaaat tcattgccatctactacatggcatatgcctatttgtcttcaggaaaggtatgaaatacatatcagaacacttaggcataagtttgactggtcttgcttgaaggtcttga aatgatcacttgcttcctttcatatgggtgtgaaacgcgtgtcaattggatatattccagtctttcctccaggatttgcaataagaagatactttataatacctttatctcattgg atgtgcaaactctgtaggatagcaggccaagttctcaagttcattccaggatttgcaatacaaaccttggctgactgcccgtcatttcacgctgtgt tggtcataatgactatgagcaggccaagttctcaagttctctataagaagatactttatataaccttttatctcatttgg |
| Contig40_gene_544 | 1069 | atgagaacattggaatggaagacaataaatagcttatagatcaaaccaaactgccagatgaatgtgacttatgtctactgcagcaattacaa gcaagtgattacacgcaatttaaagatatgattgttcgtggagccctgcaatcggttgtctctgtcctttggtgcactgtcagcttgccg gagaagacatggaaaagttgcagttgagatgctcgtgagaatcacgtcactctacgtcagttaacctgcaattggagagttatggcagttatgatgacggaga acatgcttgatgagcattagaagtgctctcaatgcaggagcacttgcctgcgttgattatgaactgcccttggagtcttccgctctgcattcaatcaggaaaga actcaagtgatatgtgcaagcgatatgtggcgatatcatgggcaagaaataagcagaagaagttggcaaacaggaagaattcctgaaaactc attccagatgttgcaagcgatatcatggtgctcttgctgctaagagtcaataagaatagatagttgacattccgttctatttatgaggagcaagcaaatagcccgaacaatcagcacattgataagcaaa taagataggctcattcatggccatcttattgtggaggctaagtccatcttgtcttgctctaagaggtttgacattccgttctatttatgaggagcaagcaaatag gcatcttgatacagaaatagttccaaggacccttataacagggtcattacagaaaagagtttcgattgaataattgaaaagacttaaga gcttttctaa |
| Contig40_ | 1070 | atgttattaagtaaaatttttagaagaattatatgggtatggaacctccattgaaatattcttcttacattgctgtttccattccacttgg |

FIG. 9B-194

| | | |
|---|---|---|
| gene_552 | | tttgcagtggctgctgaagaatgagcagcttcaagccacttcaatgtttatgaagcttatatttctatcatgagaggaactccattgatgc<br>tgcagctgattgttgtattcttggtccagagatcttcttgcagaagaccttcaaggattacacgatgattgcagttatcaattgctttcacc<br>atcaactatgcggcttacttcttattataatcatcttgcctcaagtggaatcgaaaacggacaatatgaagctgcacagtattggatatac<br>cagagttcaaacattcttctttgcttgcaatatgcaggtattaaagataatgctcatcacaaatgaggtaatcactcttgtaaagaca<br>cttcacttccttgctcattgtattcaatgcgcttgtggcaattattatgaacgctttgaaaagagattggattattacgatacatag<br>ggtgattctattatgtattcaatgcgcttgtggcaattattatgaacgctttgaaaagagattggattattacgatacatag |
| Contig40_<br>gene_561 | 1071 | atgatggttttggaatagaagatccttgatttgggagttatgtttttactccattggaatgacattggttttgttgcctacggcgcattaaa<br>ctgaataatgaggattaa |
| Contig40_<br>gene_562 | 1072 | atggtaggttacgtaggttacctagcatgaaagaacaaattcctctgaagactttttgttgcaggtagagaaactcaccatacattggc<br>attaagttacgggctactttttatctctacggcagctattgtcgtttcggttgggaggtgcaggtaaatatggtatatgttgcttgcat<br>tcttaatattcttgtaggatattcattgcattgtattcttcggtaaagaactcgtaagatggtaagaatcttaactcctaaccttcct<br>gagttttaggccgcagatttgatagtaaattcatacatacttttgacttttaatctgaagatacctttttcatattggctgtcgtatgcgatttaatgcttt<br>tatcggtgcagcaagatttatggaagttgttatgtatactgaaggaacatgtttatcgaatgttgattcttcttgtattcatctattggta<br>tcggcggtttgaaggtgttactgaagcaacaactgcacttacaaacatgctaacactctcgtgtgacctcctgtgatgcttgcacagcttgacaag<br>ctccctaaactgggaagcccattctgtgactctcgtaacctgtcctatcatcatgagttatgagcatagctcagcacagcttgcag<br>taagttcatgactgtaaatccaataagaattgcacagttcctctcttgattgagctgtcttcattgctgttatgaccgtaccgcttatc<br>gtaggttcattatgtaacgtatactctctatcagaactcctcttgtagttgctgtagtggtgaaatagattcaatcatccctacatt<br>catctcaactgcacttcctgaatggtttgatgtcgaatagttgtctttaggcctaataacaggcgtaatattaaacttgtatgt |
| Contig40_<br>gene_565 | 1073 | atgttagatagattaaaagcatttagagctcttgaatagttcgatactcatcgaatgtttaggcctaataacaggcgtaatattaaacttgtatgt<br>tcacagccaattattgacataatactcatagataacgttttctactagaggaaaacatattttcaagctaatgaagatgctgttgttcctc<br>ttgtcttctgttttcgattgttagtgggtggcctcaattcagacattagaaaagattgtacaatcggtgggcgaaccatcctcatctacttatt<br>acaactgccttgcagtttcaatagctctctgattgcaagcttcatccttctgattgcaagctggcgatacatgcgcttgcaactgcctcaaa<br>cgttcaaccatgttacaataccatcattctagttagtttccagacaacccaatcaactcattgcaaatggagacatgctccagtaa<br>tcattttggagtactggtaggaatcattctagctaagctaagacagaaaccataaacaaggtctttgaggagcaacaacatag<br>atgaaatgactcaatagtcatgaaatttgcccaatagggtgttttctgtcttatgctaagacattgcaacctagctgatgtcttat<br>gccgctgagcaaatgtaatatgtaagaattctgctcataggcctgcagtgcaggcattcattgctatccgtcactattgccatattacaagattga<br>atccgataacaagtctcttaaggagtctctttaaggagtctcaatgcattccaatgcatcttcaacatcaatcaattcaattgaacctagaaaa<br>ttaagcgaactggagtctcaaggaagtctcatgatcttaatggagcaagtgcgctacttacagtaatttcactg |
| Contig40_<br>gene_570 | 1074 | atgttcttagataggttttcattagaagaaatgatttgaacttttagaaatatattaagcaatcctaattgcttcttttgtatttatt<br>gaatatttttttaagttctttggagattcttttaaattttattttgacgattttattttgcagttatgttgttcagcttttaatcttg<br>ttttccatataagatagacaattttctgataatttgtaatcataacaatattttgcagcattcttttggaatatgtttgctttattcttaagcca<br>ggctctgtattttgattattggattttggcttctttatttctatctatgtgatttattttaattttgatttatgctttgaaggtgaattgaatgt<br>ctcattttga |
| Contig40_ | 1075 | atggaagatgaagtaatagatgttgaagattgaagttatgaagtaaggaaacagcaatagtagtagcgatagtgaagaggataatgattactctaaaag |

FIG. 9B-195

| | | |
|---|---|---|
| gene_571 | | ttcaaatgataataattacacatccaacactacattagaactgcaaccattagcttatccaatgaaaagtaattatacttgcttagtgcaa<br>ttgttctcattgcaatattcttattgacattttgttaa |
| Contig40_<br>gene_574 | 1076 | ttgttcttatttgccctatccttgctgaagaggcacatggagaccaaatcaaatgccaaacaactgtctttctaacatcagacaacgtttaggccacgatgaggacatgca<br>aatgctaaatgatatcaaacagcagattgagacatagctgcgacatagcggcaaatcaaattgcctatgtaacaattgcctacttacagtcatagttgatgagaatgcctcaaaccctgagaaggga<br>ctcgggcaatgaatgctgattgcgacatagctgtgcacatagcaggcaatagagatacaatctatgtgaatgcaacaatccctcactctatatctatgattctgaatagaggcaaatggcaaataaccttcttattgcgacaaagttctatgggaaacagacaatg<br>accaaaagataatctatgtgaatgcaggcaatatctatatgtgtactctcactctatatctatgattctgaatagaggcaaatggcaaataaccttcttattgcgacaaagttctatgggaaacagacaatg<br>cttcgatccctccaaaacctgagctctgaatagacgggatacattgcagatagatacggatacaaatacttagaccgaatcgaaataccccctcaaaaagattgtgaagcaagtctattcaaatggagtaatcagaaaactggac<br>gaaacctgaccattcgagctctgaatagacggatacattgcagatagatacggatacaaatacttagaccgaatcaattatagagcgcatcctattcgtaagatacggatacccaaatgcaataatgcagcaacatttccccccag<br>tcagattataaaacagacacaccacagccacaattatgtatagaggacaattatatagcgatatctcaatgaataatctgtgaatgcagatattggattcccaacttagtaatggcatgattt<br>ctatgctcatacacaccacagccacatctctgcattcaataagctataaggagctacaatgcgactccaaaatgccgacttccaaaatccccctcaaatcggtctaaccattggcccttctcctcactcgcaaccaatgtttaaaactcaaagtttaaaactcaaaatgatttt<br>catgaaaggctcatatgaacttccctcaaaatgccgacttcc |
| Contig40_<br>gene_578 | 1077 | ttgatagaggaaatcttaaaaacctacaatacaatccaccacattgaaggtttaaccaatcatgaggctaaagataaatacgccctaataa<br>gattcaagaagcaggaaaagcagacgggctgttaaaacttttttatccaatatctgccatgcattaaactcaataatgattctaattcaagcagcagatatcaaggctaaaagatatttcataatgcgctaataatctatgaagaagatctattaatatttctatcaagagtcagaa<br>gcatctaattggtaaacattttagatgctgttgtaatagtattgttgtaataattaactcaataattgatttattcaagatatcgtgaaaagctatccatctacagttacctgcaagcttttgcaaatcgttatgaaagcttttgcaaagcttacaat<br>aatgccatgcaggaactaaaaagcctagtgagcaaggaacaagtccctgcagatctgcttctcgttgaagactgatatgagaacatcatcctgctgaaaagctttactctgctaa<br>tggagatatagctctgattgaagaggttagaaaaaatgctgattgtctcaatgaagaagaaatgctgattcctaatgacatgacgaaaaagaatctgcagggaataagaatacatattcaaggatgagcaataagacttcaataagtcttgaagctttgaatccattaccaagag<br>ctgaagtctgaagaggttagaaaaaatgctgattgtctcaatgaagaagaaatgctgattcctaatcctgagaggcactggttgtgattgcagttgaagatggaggcttgaatggagaacactacaat<br>cggaaagattgccactatgttcaagaagaagtgtcaagaagaagatgaggagactccttggctaaaaaagtggacaagcttgcaaaatcatgaagatatcatagaagatgccaagtttcctggactcagtttgctgcagcttgctcaagctgcatagcttcagtctcgcaatgatagcttttctatcagtttaccatagagtcctcagcttcagttcctatcagctggctcaa<br>attcctgaaggattacctgccgtttttaacattcatctgctacagataagactgaacattaacagaaaatagaatgactg |
| Contig40_<br>gene_579 | 1078 | atgaatttaatagcagatattgcaagtgtcaagtggtctcttttggatgagttagttattgattgagttagttgtgttattgcattaatgacttttaat<br>tggaaaaggctctttctgcagatttctaa |
| Contig40_<br>gene_602 | 1079 | atgagaactgaagttcgtatagctcggttttgaggtcaaggagttcaaggagttcaaggagtcgtggaggcgcttcaagaactgaaatcgttgtaagcgatgaagagattgactatcctaccatccttatgataatat<br>taatgctgtacagaccagtccagatattccttgtcctgagcctcgtgagggcttcaagaactgaaatcgttgtaagcgatgaagagattgactatccta<br>aagtgacaagtccagatattccttgtagctatgtccatgaagccaatgaaggccctaatcaaatatatggtgactgaaggacgaaggtgttctaatcattgac<br>cctgacatgatcgttgaagaggaaattgtgatttttgaaagagcacaagatcaagctctacagagcccagctacagagcccaatcacaatctacaagtcactaatgtggtttctgttgatgctgtcaaaaagctattt<br>tgttgagtgtgccaaaagtgccaaaagcacagaggataaaaatattcaagcattgaaagcaggtgtatgcttaattta |
| Contig40_<br>gene_608 | 1080 | atgatttgaaaaatataaaattgctacaatcattacaattattgcattatatcattggcctatgcctgactgaagtaaactacttctc<br>ttacaagaatgttgtggaacatgatgatatcaatgctgtctgtagtaattattccatccattgggttttgagaagataaacaatgttccatct<br>ctcaagggtttatattgatcagatgtctaatcttccaaccaaggagatgtggttctatttggacataggacattggcaggatctcttttcttg<br>agattgacagttgaagaaggagataattgtaactctcgaatggcctgagataggcctgagataggtgagataacatatacagtcaatctcaatcttctaagatagttcc |

FIG. 9B-196

| | |
|---|---|
| | agccagctatggtctgtatttaaatgaaagccatatgaagggatattcacaatcaggaaatttatctaatcacttgccatcctctggtctt<br>cagctgaaaggcttattgttggagaattgaatctacaagtctaattgttcattgttcatttctccgaaggaaactgctttggaggaaaatccacatgcatcatgggcatgg<br>tataacttaggattccttgctttagattgattgttcatttctcctgaagagaagaagattatttagcagttgtgattataat<br>aactattatttagtttattctgcttattccaattctcttctcagattgggcagatcaattaggatggctgaatagtatgatgggtgttaatt<br>aa |
| 1081<br>Contig40_<br>gene_609 | atgtctaatcgattttaattccttaagaaaggaattctaagtgttaaaaatctgaaatatatctccaaaaattaaggaaattcaaatcgaaagaagaataa<br>ttctaagaataaaagtctaaatcaactattgaatatagttcctgaaaattctccattacgtaagaattcgactgattagactctgattctg<br>gattttcaattcgatttatttgattccgtgagggtgtcttatactcgtccagttgtgattgtctgaagggtgacttatactcat<br>cctgcgatgactcatatgattgatggagtcgataaaagtcaaaataatatattttgagatgattaagtgatagaaatttcataaaagtaggaaatccc<br>cagagatgcagctatatgagagttagatagtatgatgttaaaattataaaatgattcttatttgatgaaagttattctgatttttcttttaaa<br>cagataaacgcttaacatgttagatagtgtgatgtgtcttatttaagtaattctgtttcttttctgatttgataaaagttattagatgatctaattt<br>aaggatttgataatgctattgaatggtgatgctttacttccctaaatccaatgtattaaagcaaatgcttaatttaaagatgccttgaataaggatgaca<br>taagagcagtcactcaaagaaagcttccctaaatccaatgtattaaagcaaatgctttattctttgtatacaaccattcaa<br>attccaagagccgcttgaaaaattgttttttatcttgatattttggtttgcatcatctatgtttattctttgtatacaaccattcaa<br>gatgaattaaatttgaaaagaatgcaaagctaaataaatgaactaaagaagattgatattttaatgtatgcgacgaaggatt |
| 1082<br>Contig40_<br>gene_610 | atgagattaaaagtgttgaatgggatatattttagcagtatctgatgctatttcaatttaaacatagcattgatttctagctatttaat<br>ggttattgataacaatttaatatatgcaagtctatgtatcctcttgcagttgttttgactctgtagatcgtagatgggttctagaaaacttaatc<br>gtgtggatccgttaggattggtatgaatagatagatctgaataatctgatagctcctatgcagctcctatgctatattactccatagggt<br>tcaagcatttcatcttggccgatatctgatagctagcctccaattgtatgatcattactttagtttgcggtcttttaaggctgaccagatacaatgtgat<br>agctgataaaatcaattatagggatttgtagcgctcgtcctcatttaatgataagcacaatcagatatccaaagtgataactattatcttattggtctt<br>ttgctgttgcagctgtcgatgttgcatttgttgatttgtccaatacaagtattttgacctattaacttcctgcttttagtatgttgttttagcattggtt<br>ggagcgctaatgatcttattgttggtagtcttcctagagttctgttactgttcatcttactgttcgacctattgataggataaggccagtgataaggtaagcaatgttaggaga<br>ttacatgttcatgacattcctagagttctgttactgttactagtaaaggacgtcttttaaagaacatgaaagataccatcaatcctcaatgaggatttg<br>ttaccgaaagcaaggtcagcagttctgttactgttactagtaaaggacgtcttttaaagaacatgaaagataccatcaatctccaatgaggatttg<br>gatgttggtcttaaagaagatgctgaagaggaaagaagcttagacaggagaaaagcttagacaggagaaaagttgatgataatggttcaggttctgaaagccgatatgacgacactagctgtg |
| 1083<br>Contig40_<br>gene_616 | atgcaattgacattaagcgtcataaggaagcttagacaggagaaaagcttagacaggagaaaatcgaaatcaaactggttccttcattgacatttatttacattgct<br>tatattttagtggttacaagtacccttggagctgctacagttgatgataatggttcaggttctgaaagccgatatgacgacactagctgtg<br>atgcggagtattatttgattcctgttgccgtttgcagaaagttactgtcagaaagttactgtagtgtgatatgtcctctgagattaaggaaatgcaattggt<br>gtgcatgcaagagtccttgaccaggagatgttcagattgttcagatttttattgtcgaattcatgtctgaagcattgaagattggtat<br>acggttcacacgccagagtag |
| 1084<br>Contig40_<br>gene_617 | atgattatagaaatgctaactgtctgatgattgatatgattatggagatgctgcaaagcggaggagttatcaccatataattctcttgcttgtat<br>ctatgtcttttaatatccattagaaacatattttaccttaggaagataagtaaaatttgatgctacagagattatgggacaattacctcttcta<br>tggaacaggggcgagctattgaagccttgaagacatcagtcactaagaacctgtttcaagaacatgtctgaagcattgaagattggctat<br>aagaataagacagaagttgaagaaagtatggcagatttttattgtcgaattaagtatgacaaatggatcagtgcttaaagaccattat<br>tgagcttgctccattttaggtctaatcgctgtgctttggtatttggatgacctttaagaatttaggtgtgaatccagatgctgcaatgg |

FIG. 9B-197

| | | |
|---|---|---|
| | | ctgaaggtatttacattgctcttattactacaattgctggtttgactgtagctattattcttatgcctttgtacacttatattaaaggtttgatt<br>gatgatgaaatggataaaatcgaattggcaactaaaatgactaattggagttatgcagttattaagattcgtgtttatgaaaattgccttgtgt<br>ggttgaagctcttcaagaggcagatggtatcgtaagtgttaaggagattacagatccttattccaatattcagatttcattcaagcctagtatgc<br>ttgaaaagagtataagcaatatcatttagagaaatgtgatgtaaagtctgaaattactgaaagtaagttgagacaatag |
| Contig40_ gene_635 | 1085 | ttggcttcctttattccaaccctaaatggattggggtttgcttatataggcgctaaggagtttaaaaataattggattattgaaggtgtgattta<br>cgagattccttggtttttattatttatctttgtaaataatgaggatcttggagtgttctttgcaacaataggcttattgggaatggctgtttcct<br>ttgttaggtcactctatgtctactataagcataaggacatattgatagatgacgatgccgaaagtcggataagcactgaaaagtccatcacttca<br>ttttgggttatctttctgttataatctttttaaatgggcttggtttgatatatgtcggatttaaaagaaacgttcggcaatggatattggaagg<br>tgctttctttgaatttttatggcttctatttttatcacccccagcaataaggccttaaacagttttatcatttcacttggatttattggtatga<br>ttctatctgtcattagaacatttatggtctactttgaagaggaaagaatggatggaggcttttacagtccaacagctgttaagaaggagccacct<br>gctcaaaatcctattgaaaacacaatcaattcttatagtgagaacaatctttcagatgatgatatagttcctgagttcaagggatataagactca<br>agttgaggatttgaaagacgcttttaagactaaggaagacaatgttaataatttgttatctaagcgttttactaaagaagagcttagctatggca<br>gattcaagtcagttgtaaatgagtttcataagacattctattctcaggcagattccactttaaccatgattaatctggctccagaatacagcgaa<br>agagtagatgagaccataaaaaataagataggacttatggattcattgcttggtgagatgaataatcttttagaagaacttattcttaatgatgg<br>acttccagagaagtcagatgaggaaatcactgaattatttgaaaatatgcataatttgattaattctgttgacg |
| Contig40_ gene_638 | 1086 | atgggaattaaagaatttttcctaaataaagaaaaaagaaaaatcgttgctattgagaaagacttaaataataatttaagcattttaggaggcta<br>ttctatgggaattaaggaatatttcatagagaaaatcgacattattttcattctaatctccataattgctattgccttagacctttaggtgtag<br>atatttatggaatcagtcttatttggatagcaattatattctgcggcattccaatctttaaggaagcggcaataggtctttacactgaatttgac<br>ataaaggcagatgttcttgtgacaattgcaatcatatcttcaatactcattggggaattgtttgcagcaggggtgattgcagtcatcatggcaat<br>cggcggctatctggaagagtatacagtttctaaaacaagagcgggaatagaaaagcttgttgatttgaccccaagaaaggggagattgattgaaa<br>actacaacaagtccaatgaatctgaaagggaaatctcagctgatcttattgaagttggagacatattgaaagtggttcctggagagactgttcca<br>gttgatggaaaaatcataagtggcgagacatcaatagatcagtccgtattgactggggaatccattcctgtagataaactggaaggggatgaagt<br>atttagcggaacaatcaatctttatggttcctttgttatgaaagcaatcaaaaagggtgaggacagttcacttcaaagattgattaaattggtag<br>aattctcaaatccaaatgatgcagagattgtaaagactgcagataaatgggcaactctcattgttgtaattgcatttatctgtgctgtcttggca<br>ttggttttcactggtgagataatccgtgctgtaactgttttggtggtcttctgcccttgcgcattggttcttgcaactccaactgcaattatggc<br>atctattggaaacctaagcaaaggggaatcttggtaaaggaaggaataaccatcgaaaagttggctaaagtgg |
| Contig40_ gene_657 | 1087 | atgtgggctcaagtaaacactaccatcgcacttgttccaaacatagccaacctaggtcttccatacaccatggtacgattcctgtctgctgaaaa<br>ggataaggaaaaaataagagattccttctatccaatgataagcctgacattcatatcaacagtgatcatctgcctattgtttttaatatttggac<br>accctattgcagatgcgctctttaatggaagcatgcaggtattgtacatcacaactgcaatatccttctttgcatgcatgaacctaatgctcata<br>acctactttagaaccttccaggaaatgaaaagatattccctattccttgttcttcaaagctatataggggtttttgtaagcatctaccttacata<br>tgcaggatacaatatagaaacagttgttctcggtcttttaacaggctatgcagcagtattcatcatgatggcatttctcattgtaaggcatcttg<br>gattcagctttggaaaatggtcaaacctaaaggaacagcttgcctttgcccttccaaccattccaagcaatgtttcaagctgggtagttgattca<br>agcgacaaatatgttattggaatccttttagggtcagtggcagtgggatgctattcaccaggatatgccttaggaagcatattgctaatgttcct<br>atctccatttgcagttcttcttccaacgattcttccagagcattatgaaaagggagatatggcagaggtagacaaatatctcagctattcaatga<br>aatactatcttcttctcactgtgccagcagctgtagggatgagcgtactctctaagccattgctttacataataacaaccccagagattgctctt<br>ggaggttatatggtaactccatttgtctgtctaggtgcaatattcatgggaatgtatggaataaccaataatatacttatactagagaaaacac |

FIG. 9B-198

| | | |
|---|---|---|
| | | aatgatccttggtaaattatgataattgtagccatatccaacattgttttaaatctgattcttgtgccttatc |
| Contig40_gene_659 | 1088 | atgaagttgtagtatgtgagaactgtggtgcaaatatccattaaatgatgatgattaatgcattgaatgttccaattgttctggaag<br>tttaaagaacttgaagctttcagatgaagagtttaccaacaatctgatgaatcatctgatcgtcagttctgtttattgtataaatt<br>gtggtttaaaattccagattgaaaagatgacaatatcaatgatttgaagctgtgcaagctgttttcttagattatcttccaataaatct<br>gaagaatctcaagagtctcaattctctgattctgatatagttctcatcatgtttcttatgttcaatctgatgacatcattcc<br>tattcatgccgaccctaattatctctgattctgatgacatcattcatgcagaatccgattccaaacccatattacgaagaacttatag<br>aatctgatgaaattatgacgatcaatcaatacgaagatgatgatcaatactatgtaagcaatatgaataaagttcttcaatctgatgctgattcctac<br>tatgaagacgaatatgacgatcaatactaccaaacagaccctcaagaagaaggctcaggtcaaatcagcttagatgagcttattatacttcaga<br>atatcctgcttatgtgaactgtgaagactacttagaggaagagtttatctctggtgaagatatatggaaaatatgaagattcacaggattcaggatttgcatggtc<br>ctaatgaaaatacgctgaagactgagttgccagaaactcctgttgtttaacaaggcaagtcctatctgaagaggatcaaaggctatttgacagggttca<br>atagacataccagagtagtttgacagcctgaagaatatgaggcattaaggcagcagatacaaatattatgtaggat<br>aaaccaaatgtatttgacagcctgtattgacagcctgaagaatatgaggcattaaggcagcagatacaaatattatgtaggat |
| Contig40_gene_661 | 1089 | atgatgttttctaatattttccaaggatttaaatattgaaagaaggattatttatgcctattccttttattggtctatagcgcaataactgt<br>ccttttaatcaattcaatgaaagtatgatatattgttcagatgtctatatctctatctttataattccttgtattgccgaatgggctata<br>acaacacttatctatctctctcctttgattttggtgaacttcattttttattagactcggttttgtaatgaagtgtccattat<br>gctgttactgtgtatttcaatctctttgaagctttgtttgaaaatttatgtttgctgaaaagtattcaattctctttaagcttgccggagagt<br>gctttttacaagctttcattgaatcgtcttggtgggcaaatgaacttagactgcctgctgtaggattgtctgttgggcgattctattt<br>taatcttgcagttgagagattgcaaaatattatcacatgattgtttgtcttagttcattaatctccgatagaaaagaagccttttcaagtct<br>attccattgttttttgtctcttattacttacaacatgatttgttttgcttctgcattgttcggtttttcattcagtgatttat<br>aagatcatttttaaaaactgaagagttcagatatcttatgattcagatcaggagcaggaagcattgatgattatgcacatacagatacc<br>attatgggctgaacttccatttctagagcaagacttttattctccaaaaggtgattttccaaggagaattttcaataagaacaaat<br>ttattctactttcatttgcttcatttaaacatgcaagatcaggagaagaacttcaataagaacaaat<br>tgcttattttgatctcatttatattgataattgaatttcactggtattttatagatttttcaataagaacaaat |
| Contig40_gene_662 | 1090 | atgaaccatattgaaatattaggccgggaaatgcaatgtggccatatcgggttgtgtcttaatgatgattgtaggccattattacgactt<br>gccaatcattcctttgtgcagtgatttgcaggcttgcagtgaaataccaatcaatgatagttctatgaaatgaaatcaata<br>agcaaacagacaatacccttcaggaagaacagtcagtcgaagaatgcaagaaatgcagtcagaagaagaatcaagaaacctaagcaat<br>gtgattgattatatgatcaatccatatgcctttctgaagcttcgttcgtgccagcagttgaatcattgtgcaagaaacctaagcaat<br>gcctttgtgaaacatcacagttgcaacctaacagttctgcttgcactattttatggaaaaagattccttcaattcatttcaaggatgagaagtcat<br>tattgtttattcaattatttggatttttgcacttatgcacgtagattgttgtaaggatatgaaggatcttaatatgaagtgacaag<br>ctagaggagcaagaacatttcctatattaatgttttctatatgattgtgatagttccatatcatgtcctatcgcttatagttgaagc<br>ggttcttatatatttggaatcttttaatgtttcaggccttagcttgatatttgctataatttgctatatcatcttatacatcaatttaaaaaggattgg<br>ttaatcccagagagtttgtgaaagtctcaaagtctcaaagatcatgctaatagctattgtgcttttgttttaggttcattgat<br>tggttttagcattttgctgctcttaa |
| Contig40_gene_666 | 1091 | gtgagaaaatgatataagaatatttttgatcaatctctagatttaccctccttgctattttctattgataataagatacagtt<br>tcatgcaaagatttagatttatatgcttagcttgaaactaatgttgataaggcttcctattgctttttatcatcttatcatacatttaaaaaggattgg<br>ttgagttcctattaaagtgttgttgaacaattaagtgtgatagcctttgctatgggctattactgaagagagcaagcggaatattccaaag |

FIG. 9B-199

| | | |
|---|---|---|
| Contig40_gene_668 | 1092 | agggttgttcttaatgcaaacgatatctttttaaattagtcttaatcttgcaattgccaatcatttgatctcttgcctgtagacgttcttag<br>ggagtatataccagacattcctccagctaatcttatgagattgtatgaaagtctagagagataagtgatgatttgaatgattactttagtctc<br>aaaagttcttaaataagccgatgttattaccgttctgatgagataaaaacatatttgagagagacttatcctgatgatgtgttactttg<br>gataatacttttgattactctcttttagaattggtaatggataa<br>ttgtctaaaaaaataaggctaataaaaacaagaaaagaaagtgaccaaaccattcatgaattagagattggaaaactgattaaaaacga<br>agatgtctatacataaacaatccagattactttctgacattcagcgactcgagataagcgatggaatagacataattgaaaacatcatgattc<br>tctctaaagattatgttagcttaatagcaatagaagattgaacatcctacaattcctacacatgacaataatcacatgacaataaatcacagtaatttc<br>aacaatagaaggaggatacataagccaaagctttgataactcccaattcatcataaattctacaatgacaataatcctacaatgacaataataaggaaaac<br>taacgatttgaagtccagaagttcacagaacaatctgaaagttgaaacagcttgaaacagctgaaacagctgaaacagcttgacagatca<br>ttctaataagaccatgtcaaatcatcaaagctgtcattgcgctcattcagcttagacagaacaatctgaaagttctgttattgctcttcaatctgcagtcttcatcccccctcacatg<br>ccctccatataacaacaatatcctaaacaatgaagatttctgttattgcttccaatctgcagagtttcaagacaagggctttaaatcaggattatatatga<br>aataggattgacatcacaaatatgaatatgaatatctgaattctagattcgtttgttagcgaaggaattttaattgagatttgtagagcttga<br>gcgaggacgcaataagaacacagagcctacagatgattctagattcgtttgttagcgaaggaattttaattgagatttgtagagcttga<br>atggaactttttagaaaacacagagctgaaagtgaatctgaaaagaattgcttcttaaatctgtcagtgacagaaacattaatgc<br>attgattatgctgcaatcactgactgaagatgattttagaaagcaaagagttctgagatagatttaaatgaaa |
| Contig40_gene_677 | 1093 | atgaatgttataatcaccctgataagaagcagtcactacttgtctgttctgtttgtgaaagccgtctgtcagattgtgctatgaaattgcagg<br>aaatgtctactgtaaagattgttaatgaatttgttaatacaacaagcataatgaaaaagcaagcactccagctccagtcctcaaagagcagccgaaccaa<br>taactgaagaagttcagagagctgaagcagtgaagaaagctatcgaagagcctgttgaaatcatcactcctgttcaacaagaagaagagttgaagag<br>attatccagaaactccgaaaaaagctcctgaaaaatcctgaaacttgagcctgaagttgaatacgaaacagaatatgtagagacatatgaagacgtgt<br>ggaagacagctattatgaaaataattccagaaactgaaagtcattcagaagcttgtataatatgagaaagaagctatagtgatgatatgaagaagctta<br>aagagaagagaagaataattgagcagttcataaaactgaagacattcagaaatatgttgaagaagctatagtgatgatatgaagcagactttatgaagaa<br>caacctagcaaagctccaagtaaggaccttgaagccaaatatggaagaacctcaaagaagaagacctcaaagagaagaatatttggaagacctttatttagaagaaa<br>ttacgaagctccaaaactcaaaaagacgttcaaaactcaaccggagagtttaagaaaagaaccctaaagaaatttgaagagagaaatcaaatagaagaagtccta<br>gaaactattccaaccaagagaaactgaaagctatgaagagttaaaaagaagaaaagctgaaaagaatttgaggagaagaaattatgctaaagagcagaagaagtcctagtgatt<br>gctagaaagcgaagaaactgaaaagtctaaaaaacaaaaagaagaaacctgactatgaatatgatgaattagaaaaacatacaagaaa<br>cagaaggtctaaaagtctaaaaacaaaagaccctgactatgaatatgatgaattagaaaaacatacaagaa |
| Contig40_gene_693 | 1094 | atgtctgaagaagaatcagtacctcaaattattgtatctaccgatgatatgcagctgcaattaataaattggatgaagctgaagaaaagtaga<br>attcgctgttgtgaatacttccaacgtttaggacaacaaacgttggtatttttattggtatttttattggtcttgtaatttaa<br>tagtatctattgaatttggtttggtaagtgcaatgagtacttgcttacaagcttagtctaa |
| Contig40_gene_694 | 1095 | atggttagatttcaaacaaccaaatactcgtggtattagaaatgcttctaataatgtagaataccgtgcaaagctcttaggtagagaaggaag<br>attatttgctggcgtaatcagcaccagattttctggtattgtattgattagctcttgtcttagcagttgttattccatactagcta<br>aattatgtggttttatag |
| Contig40_gene_695 | 1096 | atggctgacaaaaacctgctgctgataactggcctgtagtaagtggagactacattgtagggacccctgaaagtcctgttgctgtaactacctt<br>agcttctcacatgaagatattccagctgctgctggagcagctattgctgacctgtaagactcactattaggtattgaaaagttgttgcaa<br>acattattcaaaccaaacatcagattcttaatcctttgtgtctgaagtgcaagtcatattcgttgaagtatccaagcattacatgaa<br>aatggttgcgaccctgaaaaagatcactgtgtctattcctttcgtagaaacatttccttcgtagaaacattcctagaagtgtagaagattcca |

FIG. 9B-200

| | | |
|---|---|---|
| | 1097 | acaacaagtagaacttgttgacttgatcgacacgaagacgaagacggtggagcaatcactgcaaaagtaaaagaatgtatcgagaaagatcctggtgctt<br>ttgaagaagatgctatggttattgaagtgaagaagagatgacgaagaacgaaggtgaagaaattcgtcctattccgctgaaactgcatta<br>cttgaagcaagaatcagaaacattgacactcagttagtagtggtgctgtacaaagaaaatatggcagttcaggaaagtccaagg<br>tatcatgattgattaatattcactttagtagtcggttcttgttattaatgcaccattagtagtgcataa |
| Contig40_<br>gene_696 | 1097 | |
| Contig40_<br>gene_697 | 1098 | atggtattaccttaatacaattattcctgaattaaatctgatcctgaaaccggtctctccggtcgtggagattaatcat<br>tctttcaatgatgagataaatggagaaatcgaaggcgcctgaaaagtcgaaaagtgaaggcgctgctgaattcctagatccttagatcctcgcaccattag<br>gttccttccagagaagaggttaacttgttattgcagaacattgaccaatatggttttatgatttattattataggaatgttccttatcatgca<br>gcaatgcctatattaacagctatgggggttttatag |
| Contig40_<br>gene_698 | 1099 | ttgaccaagtcattgcattgtcttgtgcagtttgtgcaattcttgggagttcttgctattcgtagtgtagcaagttacggttagtactgg<br>tgtaccttctattggttacatgtctttagtgtatagttcttttaatcgtgtagcagcggttaggttataattgcagcattaatttaaaagattag<br>aaatgctcgaccaatacttgcattgtatttgcaatgctctgcttgctgcttttattagttgcaattgttgctaagaagattgttgaatgaactcct<br>gttatgaaagatcgacacagctgaaatcgctggtgctgctctcttttacatatagttactatgcatctccaacaccattcagttgcatactctattgattt<br>attattaacgctgttgctagctccgtgagtctgattcattgcatccatcgtctctttactatgctaccactcgattattactgtatctcgcaattccgctgaga<br>ctaacgaagatcaagttagaactcttaaatggtcatcacctctgtatcggctatccacatgttaatgcttcctacgcaatttccgctgagga<br>tacgcatgtttgcaattttagttgtcaattttagttgggtagactttagtgttgtagttgttatgcttcctacgaagctgcagcatctgt<br>taaatgtccgattatgccaaaaagttgaggaataa |
| Contig40_<br>gene_699 | 1100 | atgaatctttttataatattgtgtaatcgcaggtattatcgcaggtgttatatcactcttcattctgtaggtggtctcctgcagc<br>tatgctaccggctaccggtgtaggaactggtataccggtcaatgttagcagcggcaagatttaactgactattacccgcagcttctcatgaccggtc<br>aaccagtatggttaatcgtattagcagggcagtgcagttccatgttaatgatgggtataccatgctattgttaacccaggttcggt<br>gttggtgtagtaagcacatctgtaaagcagcagctctgtaatcatcttggtggaacagaaaaatacaaacccaggtaccgaaggacacgg<br>tatcctacctgtctgtaacataagtggtataccatcgtattaatcatggttaactggtggtagctactgacatgactatgaatttgcta<br>ctgcaaacttaactggagtttgacgctacttgaagttcgtaagcgctatctcttttgagacagtttactactctctggtatgttctttatcaattcgtaactcgttcc<br>tataacattggaggtactattggaaggtctcgtagacctaaattcaaaagactcccaactgggaatcctcgcttgtctggtgttctcgttgtagc<br>tgctattttcatggttttaatgatagagttaa |
| Contig40_<br>gene_713 | 1101 | ttgacaataatttcaaaaagtagaattgattgaactcttctatgattttataattcgtatattcgtgatttaatttcgtcaatatcaaggcttacttcaattataagtga<br>acctgtcaatggaggaatagctccattcagtcttcagtgtgttgcatattattcacttccttgtcatttgttaccaggcatgctcacttactactgcttactactgcttactactgcttaactatg |

FIG. 9B-201

| | | |
|---|---|---|
| | | taaccgttatgccaatgaagtgtatgcaattcattgcaatcataaacatgattgccgtaatctatatgcaaataccatatcctgact tggaacaatattatttgtatttccatgctgataatgctcttacgttgtattttgtattctgttcatgccataaggaaaaatcatt aagggagctgcagtaatcaatcactattctgctcttgtattctgactgagccttttgccgttttatatgatcattctatttggcatatggatg ttgtcattggctcaatgtcctgctatcttgactgagccttttgttgaagctgtgtggaataacacattcttaatgtaaacaactttgattt catttgatagaacgattgaattgctgacaatcattactttgtttggatcatatgttcttcaaattcactactagctcagtcgatcatcataggaagagagaa tgttccaatactttgtatcctgattgtcattattcattgtaatagcattaatctggtactgtgcctttgaattgattcacagcgggagataaactat gcctaagattgatgttcagtcattatttcatttcattgatgttctctatctctccattatgccaataaggaatattattatgatggctagaattaag tggataccgagcctgatgtgtataattcatttggctttaatgttgattagttaataggaagtattgctatttactatctgttggcagca aaaaagacattgcattgcatttaatgttaggttgattagttaataggaagtattgctatttactatctgttggcagca |
| Contig40_gene_722 | 1102 | atgtttatatcttccattactcttagcgctaacctaatttccatctcattattgaataagcgtattgatattggtataggattggcatattcctc attcattacacatgaaatctccttgtcagtgcctatcttcagttatgaaatcctttggatttgtaatgataatctttggattatgtttcatatttgcaa tcaatgcaattttccttgctgaattgcaattctacatgttgaattctacattgtagcattatatgcattgattgctgtagtcgattccttcagatagcaat gttgctagaaccggcgcttattgtatttgtcctagtatagtattttatttgcttattgcaatgtttgctgcagaaaacctatactaattacaat tattttagtgtgttatttaatagcacaaggaataatggattaataatggcaatgaaatataa |
| Contig40_gene_727 | 1103 | atgagaagaatgtttaaaatcataggaactcatagagaactgcacacgtgtctcaaaatagtgtggaaagaagtaaagaagctatttagaagacaaaccaga agtagtcgctattgaattagatagaagaagatacattagattaatgaaagaaatgcattgtagaagatgaccaaatccatattaccaaaa tcataaagaaaacaaagtagggtttcttagttacaaccatccttcagtgaagaagacaggttccagaatcgcagtcgaagaagacaggttgcagctgaaatcgagcactcacagccataacaagcctgc tctgaaatgatcgcgcaattggaaaagctcattgatgcagctgaagaagcattaatgaaagaaatgcattgtagaagaccagttccagaatcgcagtcgaagaagacaggttccatcaagcctgc aaccatatgagcactgggaaaagctcattcattatgaatcatcggaggcttgctctcatcagatgatgaggctgtaaatgaaaggatgcatat tgaaggaacagtctgcaatcgatgagcaatggacaattccagagacaattccagagcaatgtcatagcggttcatagtgcaggcatttgtaaatgaaaggatgcatat cttgcaaacagcatattgcacattccagaagacaatccagagactctgaagtggtactctgaagttgcaggcatttgtaatgaacaatgcttgcaaacagcatatccgaagagactctgaagtgtcaggtctattccgacaagaaggaggaatctcggcttaagataatcctctgattcctatctcat ttgttgtgatatttttctgcttgatgaatgaactagcctctgcaaagctagcctcgcaataatcggaggattagttgctccactcactattccaccccctccttgcgcaggctg ggctcaattctttcaggatcaaagctgaaagctgaaagctttgaagcaaggtttaaagctgaaagctgaagaagcaggacattaataatattaatcgtacttaacggactttctcccttgcagaaatcgcagt |
| Contig40_gene_729 | 1104 | atggaaattggactggactcgatattcataatctagtgaaatactaatcataatattaatcgtacttaacggactttctcccttgcagaaatcgcagt tgtctctgcaagaagaatcagaatgcaaaaaaattgcagatga |
| Contig40_gene_731 | 1105 | gtgctctaattaaggtgcagatgtcttgtagacggtgcaagtaatgttgcataaccatttgtacaacctttaaagataccaaacctataattgtaggactcacaat cgtcgcatttggtacaagcgctcctgaagcagctgttcaattaccctgcagcagctgttcctgaagcagctgttcctgaagcagctgttcctgaacaatgcgatttcctgaagcagctgttcaattacctctgcagcagctgttcaattaccttgccgaacaatgcgatttcctgaagcagctgttcaattaccttgccgaacaatgcgatttcctgaacgttgtagta gtaacatattcaacatattggcctcctcttcaataggcaccacatattggagagataagcagattcgcgtaggtattgataaagagagtatcttgataatcattgc ttatgtctatgtccttgttcaaggaggcaagacaggacaagaagcaatgtctgaagagattgaagttgtagactcatcaagctatttgttgagattgaagttgtagactcatcaagctatttgcaagcgtattcggattaagcgatgta acattgtcatagttgccgaatcatattcggtccgatttggttgtagacttcatcaagctatttgttgagattgaagttgtagactcatcaagctatttcggattaagcgatgta cttattggtcttacaattgttgctatagaacttcattgcctgagcttcattttcatttagtatcagcggagcaatgcgatcacacctttaaaaaagagacaatgcaacctgaacctgaaatgttaat tggtaatgtcttgatcaagacagttgattacaatcattgccgagcctttgcagcctttgccactcccaaatgccactcccatagcaccttcctattaat gggacatactttaatgacagtgattactacacatcaattggccgagccttgcatacaccaaaatgaagtggataaaaagaagtgccgtttagta |

FIG. 9B-202

| | | |
|---|---|---|
| Contig40_gene_740 | 1106 | gcattatttattctctatatgcatttgtcatttaagaaattaa |
| Contig40_gene_747 | 1107 | ttggatagtgatttgattgattggaaaaatagttaatagcttatctttgatagtgatgattgatttgaaaatagtgattaatgattatagaat tattaaaatacataagaattag |
| | | atgccattaatcctagtggctttgcatcattattagctctgatgcccacattcatgatgtatcaatatcccacttgttatgacttaaa cacagatgttggaaccataacaaccataatcagtttttataccttgattacagcttcattgatgctttataagctcaaagatgcaggatgtcttg gaaagaaaagatattcctaactggagcattggtctacggcttggaggcattcattgcctcaatcagccaaaatgcaaatatgctcttatcga tggtcactattggaaggtattggcggagcattgatgacacctgctacaatcaatcataagtggaacatatgacggccagatgcgtacaacagc ccttgcaatctcaagcgcaatcgtcggaattgcagcagctatcggacccattgtttgaggtgttgtaaccacattcctatcctggagatatggat ttgtatttgaactattaattcttattataatattgcttgtcttaggaggttaatgattcggaaaagagaagaacaatcggatttaagcatagccctaat acaggatcccttctctcgcataggattaattgcttgcactcttgaaaagagagaggcaaatggaaagatgcctttatttgatgtaagctcttaa cattgcagcataatcgtgctaattggatttggactcttggactctatactgcctcacctttggaatgctatattttcaatatcaatctaccttcagaca aggataaactctatccggcattcaatacagggattgctcctatagacttgatcattgtggaggctcaattgcaatggggctcattgtttcaatatctcacaatctatcaatatgcaccgaaattcgcaat gttctcaagctctctgcattcaatatgcaatgataatcggttttcaattgctcattgtgggatgcctccttcttttaagctatc |
| Contig40_gene_748 | 1108 | atgggaaataaagaagaaagctgcaagacaacgtttgatgagatcatcggcgttgcaaaaagacaccacttagcaagctattaacaaa taacgaagacgatgaagacttttgaagttcagacctaagtgcaatgaaagagctggtgtttggaagaagctaggtcctgcatttcatcaaattagtcagcttttagcta caagcccgatatggtaggaagactttaggaaaatgatatattgcagatggactttaaagcttttaaggacaacactccagcaacttccttttgaagaaatgagaaaggtc attgaaggagagcttggaaagccattggaaagcggcatggaagttgcagtaaagttcaaaagcctgaatctgaattcatctgaatcggcaatcggccagtatataggc aacattaaagagaagcggcatggaagttgcagtaaagttcaaaagcctgaatctgaattcatctgaatcggcaatcggccagtatataggc tagctgaactgtagacaaacatgtatccggttcaagaacctataactttaaggaatttgaaagttcaatattcaaggaattg gactatatggaagaagtaagaaacatgagctcattgacggatacgaagttacagaccttttcgacagatcttccatgcagaacagcatcaacaatacagaaattg cagttcaaagctcataaacatgagctcattgacggatacgaagttacagaccttttcgacagatcttccatgcagaacagcatcaacaatacagaaattg cccaatatgaaccaatctcctacctaaagcaagttggtatgatggagtggtaaacgaagtattgatgacgattcttccatgcagaacagcatcaacaatacagaaattg gctaagctttgctacatcgactttggtatgatggagtggtaaacgaagtattgatgacgattcttccatgcagaacagcatcaacaatacagaaattg aactcacaccattcaatcaattgctctatatgcattgctctatatgaatatcatctcccagaacagacactgacgagttca |
| Contig40_gene_764 | 1109 | atggtccttttaggtgccatgattgcattgcattggttgcacacctattgcataagattcaaacaaagattaaatatccttcgatttctatctttt agcattgatcctgttgtaattcattgcattgaatactgctatttgcatattgtattttatgaattacagttttgcagatgtattctttaattctagtg atttggctggaatggatataaatatgcctaaatgcctcgttgcttatcagtttggcttatacagttaaaggattttctaaggcttcaattatatggttct ctatctactggttttgaaaaggctttttatcttatgtattggcttatacgtggagacctttatggagaacttcttgttatttatcctaatgacataaggctttcttttg attaatctgttcaatttattacttactctgatgaagtgatttaaggccaatatacgtgcagttcagttatttgactgcagttataattggtttatgggcggtgtagga atagaacttatggctataaatgcttttgtttgtactactactactctactctcaggtcaagtcaatttggactgttccttatttattttggcccttgcatt tattacttatttaggctataaatttgctttggcaatattgttcaagtaactatgcctaacgagtttgacagtcctttgattctttggtttttggcccctttgattt ggctttagccattcacgcatatttgttagcaatctatgcctttctttgattctcttatgccgccctttgatttctttgttctcagttaagtgtatattgt atatgctcctgtattggcaagtaacatatggaggttgttatatcgtgttattaagtcttaaaagaaagaattagaaaagatagaaaggtatttgt gggttatttagttattttaggtgatgtggtgaagatgtaagtagtgaagatctacggtctgcagttttatgcgccgccttggaaaggataattagaaaggatagaaaggtatttgt tgaaggggttctgatgatggtgatggtgatagtgaagatgtaagtagtgaagatctacggtctgcagttttatgcgccgccttggaaaggaaataattagaaaggatagaaaggtatttgt |

FIG. 9B-203

| | | |
|---|---|---|
| Contig40_gene_770 | 1110 | atgaaaagattattggtatattttatatagtagttattggaggttctttagttatataaaactataaggactctcaaatactgt
agataagtcccaagagtctatagagataagcaaaaatggaattacaatgttaattccaggtgatggtggaagcgaaatctgaatctaatacta
cagctatagcagctgcagaccctgcttctcaaagctttaggaagagactcttcttacgatattctatatgaagaaatgtgtcaattgcaggtaccgaagg
tcgtatgaattcaataattataacgtttaggaagaccggttttttaaaacagcataagccattgttaagcaaggggatgaccttatgttatcttat
tatgaagcaggttataccgagcaagtttcagagaggaagaagcacttttgacttattaataatctttaaattcaacaaattag
gtactgcgccacagagcaagttgcagagaggaagaagcacttttgacttataataatc |
| Contig40_gene_771 | 1111 | atgaagcttatgcagattttaagaatcttgaagagttatatatgatggtctgattccgaagagaatacatctatcttcaaaccagtag
gcataagatcgatacaattgtatctagacattaggatgcaatagataaggaacatgcaaggcaaaagaagttctctccgccttattcaaaatatgaagatg
ctaattatcaaaaaagtcgtgatgagaactgcgttagtgaaatacatccacaactctctgcttttcatttgctgttgtgctgaattagcttggaatattag
accaaagcggaggaactagccgtgtatattattacagctagtgcaacaagctttcctgaagtaaacagactataagtaca
cgaaataccaaatagtgatgtaggagatattattcctcaaactcttattcagctagtgcaacaatataatgacacagctttcctgaagtaaacagactataagtaca
atcgtacttcaaattatactataatactcctcaaactcttattcaagcgattattctagtgaagttctatatcttataattcctatgcgga
tcaggttatttcaagtgaggctctgttattctagcggaggtctgctattcaagtgaggctctgttattctagtgaggttcttcttactc
tagtggaggttctggctattccagtggtctgttctggttcggtatcgattgattag |
| Contig40_gene_780 | 1112 | atgtcttatgaatatcactttattcaatttagaagtcgtttaacactgataatagcctattcatcggtgttttgattcctgaattgaaag
aaaatatgttcaggcaagaattcagcaaaggattatataaggcaatgggaccctcccgttacaagctcttgttttattggcatctataaagttcctgtataagagagaata
tccagccaaatcaatggctccaggattatataaggcaatgccagttcttgtttttatttagctatattcttagtatattcttagttaatgccatat
aactatcaattatgcgctaattaagttcctaagtttcaagttgttggattttgaaggttgaagaggttgcttatgttcttatggttcctattctga
atctgatgtctgctaaggatgattgtatttggttcattccattcctattcacttgtcaggtatattggcaggtataatcgagcagtgttcttgtgctttgtcaggtataatcgagcagtgttcttgtgctttgtcagat
aaagatcctttaaggatgattgtatttggttcattccattcctattcacttgtcaggtataatcgagcagtgttcttgtgctttgtcagat
attgttgcataccaacaagcaatgcccaatcatattaaagcaaaatctgatgttgaaggaccgtatatggaattccctccagtttatctcttggaagtttatagca
gaataatccgttttcatatattcacttaggattgcctgttataatgcatccatcagtgcattcctccaatattactaataacagttatatcctactatttt
gctgttattgtatcctgatattgggagtttttagctatattatgtgattgctattctaa
attagtttctgctatggagttttagctatattatgtgattgctattctaa |
| Contig40_gene_785 | 1113 | atgtttgttctagctaatctcttaattggtccgataattacctgttatattggattcgttctaggttcgattgtcatctgatgagaaaaa
tagtttaagttaccgcaagcggaatcattgtcttcttattattgggcattaatagtgtcattgaattgacaattccttactataatgatt
tgccaatagcaactacattttaggagctcattttagtgtagtcattggcttttgattggtgtcattactggaggacgcagaaagagatcattaa |
| Contig40_gene_786 | 1114 | atggctgaagataaagatttaaaaaccacaagaaatctccaaattgaataaggatgaaagcagtcctatattaaaaatcatgtcttgcctat
ttcattcattatagcttcttcttgttgttgttatactgtaaatgaagtccattaaagttgaagtccaggagccggtttccaagtggagccatgattgcaggag
caatcatatgtctgttcttgtttgttatactgtaaaatgaagtccattaaagttgaagtccatagcttttgaatctgtcggagcttta
gcttatgtcttgctgtttggcaggacttgcattgacaggctcattctataaatgtaggagaaacctttatggcttgttccacaggctat
tgcagcaatattcaaatatcctgatttaacaaatgctgaatggtccctattaaaatatcaaaaaattagcggaagaataa |
| Contig40_gene_788 | 1115 | atgaacaatgtttcaggagcaatgcagcagaattcttaatattggtggtctaatacttgctgctttgttctttagacatatcaatattgctgc
atgcatagttgtagtttattctagctgcataatattgttctttacaaacatgcctcttgcaagcaagataaagtcagaacaatccgattcattgaaa |

FIG. 9B-204

| | | |
|---|---|---|
| Contig40_gene_789 | 1116 | aaatgttattttatgtactcattgttctgaatccttattctgtaattactggggtgaaatatgtctga<br>atggtcgttattcaatattgctgttcttgtttctgctttactgggaatgaagacagtgaaggcttctccattattgtaggacttgc<br>aatcctataattgcaattcttgccgccattgggtcaattgtttatactcttgcaggcctatataggcgaaaggacaagacagtgaaggcttctccattattgtaggacttgc<br>ttgaaccctgttgcaagctataacagtgcttatatttttgacaatagaaagaatcatattcctaatggtatcgtcgcattc<br>ctttcaatattaccactcttacataatgtatgttcttgagataaccgctttgactcaagtggtattatttgtagctcaagcacagagacaatt<br>tctatctaacgatatctcaatatgtatgttcttgagataaccgctttgactcaagtggtattatttgtagctcaagcacagagacaatt<br>atgaaatcgcattgaaatacctgatttagttcaatcgcggaccgatgcttttattaggttgttcttgaacaataggttcagtg<br>aatattacagacattatatgccaccgttccacactataaaatcagcggtatacagtaaggcaagaccctacgttcagcaatacttcaagatttt<br>gctatattcagcaggatgccacgttgcattgaatgctgcattgaatgctgcaatgtctgcaatgtcatgcatcgcatt<br>cagtattgtgcatgcttgcattgaatgctcgcaatgtctgcaatgtctgcaatatttgctatattccaggattcaatacagccataattgtatttgccattctt<br>gcaatggtttaagcattgcaatgtccattgaactcaaatgtccattgaatgctgcaatgtctgcaatgtctgcaatgcaatgcaaatgaaatagtcattactg<br>aggtttttgtattggaactcaaatgtccattgaactgcagcaatatgtccattgaatgtccattgaaatagtcattactg |
| Contig40_gene_790 | 1117 | atgattatggatatattcaattgatctttcctcagtattgcttcagcgctcttattattataggattgattcagcaatctcattgcagcaatatcataaa<br>gaagataataggtattgcattttatcgaagagggcgtaaatctattccttacctctggatacaaggctggagggttgtgccaattttcttac<br>ctggcatgactgcagactgcagactgcagactgcagactgttcctacagaagcatgaacattaagcaagcatgaacattaagcaagcaaagaaatattgggggatgaaaatga<br>gctgtaatgctgcttagcaatgtcttatacagaagcatgaacattaagcaaagaaatattgggggatgaaaatga |
| Contig40_gene_791 | 1118 | atgattgaatatatatattattgttgcgttataagtgccatcatcgcactttacaggaagacttgctaaaatcagccattctagttgaat<br>atctgttttcttcattgcagtgctattcacttattgctgctgctgctcctcctgctgctgctgctccaagccattgtagaggagctatcgtgccagtat<br>ttatcgcttgctgtttatcaaacaaaaggagggcttaa |
| Contig40_gene_792 | 1119 | atggcttaggtctcagagggtatgaacttaataactattatccaatcaattttattattactcttctgcacttataattataattgcagctattgg<br>gatttaagaatggataaagacatgcctaatgttgtatatgcaagattcatattctggaatgatagtagctgaataatagcattattg<br>gattagtcagccttttatttgctcttctaatcctaattttattaaatgaagaatctgatgaatctgaagattgcaggaagatgtga<br>ttaaataatcctgtctttgagactctgttgatgtgcagaacaagatgtgagaacaagatgtgagaattcagaaaatgtagaagagattctgattctg<br>agaacctgaagaatctgtatgtgcagaacaagatgtgagaacaagatgtgagaactgagaagaatctgatgagaatctgagaaatctcagaaaatgtagaagagattctgattctg<br>aagagaagcttcataatgaagatgtggataataaaactactgaagagaagaagagaagaagattgctgaggtgacgacaatgattga |
| Contig40_gene_793 | 1120 | atgataatggaacttttatgattcagagtgttttttaataattgcattgttgttttcttattgcatctatgagaatcattactacaaaac<br>tgtctcatgggggcttataggtacttcttcattgaacttagcaatttcttcattgaacttagcatcttcatctcgtcggtatgatcgtggtgggcatagaattctttta<br>aggcatgcttgttgttttactttttattaggaatgttgttgaacaatagcttatgcaacattttaaggagggcttaa |
| Contig40_gene_794 | 1121 | atgtttttatctagaattttattatgcaatgctctattggtagtgcttattttggagattcaaagctactactagatatggctgtaggatatt<br>taaggagaccagtatgatcctattgcattgatcattgtcattgataccgaatgaatttaaaaaggccaatataaaaagcaataagcaacagcattaccttaa<br>ctcaggggctttatctgttgattcagaaagtcaagtgattgattcaagtgaaagtggttcagttgcagttgctccaagacgtaaaagatcatcctttt<br>gagccttatataaggggatgttagaatag |
| Contig40_gene_795 | 1122 | atgtcatcttataaaggacacacaatattttgctttatcttatcattgctttatgacccctttttgcacttgcacttgcacttgacgtttatgccttatgcactgacgttcactgcgtattcggagc<br>aaatatccctgacttgacatgaattaagcgaaaacatgttttatcaatgttttatcaatgttttaatcatttcattcattcattcattgaatgatcttaagcatctttattga<br>atcgctattattttaggttgataatcgcttattaggcttatttccttatctctcatagaggcttactcactctattttaggagct<br>gtagtaataagcattgccattttttattgtctattttgaatgatcttcttctacttaattgaacactattactattccattaaa |

FIG. 9B-205

| | | |
|---|---|---|
| Contig40_gene_800 | 1123 | ctatgttatttagtcggaatttaatatttagctgtcctattctgaataagcaattggcctctatttcattctttaatgcttttcttta<br>tcacttggtttattttggaatagtccctgtctttaagctaaacgttattctctaatattctctgtgttttaggtctattcagccatatgatt<br>ttagattcatttagtccggctggaataagccattcagtccttttcagatagaaaattgctaaaaaattaggattgctttattgcttttgat<br>aattgctcttttatttgatttttattccaaataaattagattttctatcttaatcttctcccacactttattaa |
| Contig40_gene_803 | 1124 | atgaaaaatagaaatgtatggagaatcattatgactgaatttaaaaaaatatgaggattttaaagaaaaataaaacgattaaaaggaatcct<br>cgttattcctcataatattgctatggaattttagggtctattaggtttatgaattctaacataaacaatctctattatacaatcataacca<br>tagccactgtaggatgtaggagatagacataactccctgtaaccctcgtgaaaagttctttctccacaagctttgctctcaacaggattgattgca<br>tacatattaccaattactatccatttgaagaaggactcattgagaagtgagaacatatggaaagagattggctaaatggaaga<br>ccattatattctatggttttgaaggtagaaccgagttatgaagaactgatgaaaagaaatcaaaagtaataattattgaaaagaatg<br>aagacaagctagggtgattgtaacaacagaagcgatgtagacaatgcaaatgcaacagagacaagacccctaagaagtcaatattgac<br>aagtcattagggtgattgtaacaacagaagaaaatcaaaagataactaactaaagatcaaaaggaatccctgaggtaagcgaggaactgacattt<br>ttcaaggcaagcaaaagaaaatcaaaagtcaaaagataactaactaaagatcaaaaagaattgaaatactaaaagcacaat<br>actttgctgcagtcgcagcctaattgtcatataactcaaaagcatgcattgattatctgaaaggaattgaaatactaaaagcacaat<br>tgccatttgaaacatagaatcatttccaggaattaagacaccagttactgaaggtttgagtttagatgaggagaagatcactt<br>cattgatatggttaaaacaatccagaagtccatgaatccatgatgtgatgtatgaaaacgttaatggagttc |
| Contig40_gene_804 | 1125 | atgcaaggattaggagttgtattaatagtcccaacctagtgcattaatacggagagtacgaccctatgtgctccttttatgattcctgttt<br>tgtatcatttgtcttaggaactgctttttagtaaaaaattcaaagactataccaagcttaggcttaagcatgtatgtaatatcatccttgcat<br>ggctatggcctccctatggagcctcaatcatggtccttcattgcctaaatccatcctattcttaagaagctagaacaatgctagtggattaggaat<br>ggaagcggaatgactttttttgtaaacgttgaagtatggcaggtactgcagcatcccagattatataatcagaagctagagaagaaatcaagcaaaca<br>tgtaattatctttatcggaatttctaatctgagcaagctctagaaaagctctattaatctatacagcagtggaatattctttctatcttgcagggcttcctatcttgat<br>gccataaacatcacattcacaagtcatctcaactgagaatgtccatttaagaatgcaatgtgggattctaccaagacagcatgtctacctaat<br>cagcatgttctaatgatttaggtgcaacaagcttaacaataacattatatagattgtaaagacaaataagatgtccctatagaagaaagcactttaagatgttcaat<br>tccaattattgattacccttaatcatagttgctggtagtctgttgcattcttttatagcacaatagatgtccctatagaagaactctttaccatagtttca<br>gcagtgacaaccacagggcaaatgtggttgatcccatgtgcttgcaacatgaacggtccacattgctttctgatgtctgatgcttat |

| | |
|---|---|
| | gatgcacagtctgctgctgaggaaattaaaaatatagtaaatagttcagatattcaaagttcacaaagacaattctttgtgaactgctgacagtga<br>acatcttgtaagaatcaaggagaatcatgctcgtagatagttgataatgaagaggataagattactcaaatcttcaaaaaacagatattg<br>ttacaaggatagtcctacacttggatgatgaacacttatcccaatggtcttgccagtcttgcagcttggtacaggggatgtgacaaccctt<br>gcaagcgcaatatctcttgcattcaattacaactgttatcgtatttggagcagttgctgccgttacttgcattgcatcaaagatagacgatggtt<br>cggtgaatatctggatgcttgatgatgtgacaattgacaattcaataagaaggatgataggctagaataa |
| Contig40_<br>gene_838 | 1132 | atggaaattattgattgattgcttctcagtgcagccattgtattttaatctattattttcagactgtcaatgtgaggcagttt<br>tgatatagatgattaaagatgatcatctcaccattctaaaaggaagcagcacctgccaccgttaatctgatgtgatgaagcggaagaaaag<br>ttctgtagtgaaaaagattaaatatacctttaagacattgtcttttagtaaccactgactgactgaaagtttgaaaacgttgcttactgcttgtga<br>cagcattgatgacttagaagaagtgaagaaagattcagtgaataacagcaatgtaaccatgaaaactgaagaccttgataacgtattaaggcacttgaag<br>aagattctgaacttctagaagaggacgctgaacatataagaaaagaagcagatgaataa |
| Contig40_<br>gene_839 | 1133 | atggctaatgaaattataccaagtgaaatttcattcttattttagtgtgtcattggctttgtagtcattcattgcaatgaaaaa<br>ggtacgccaatctgacaatactttaaaattgatgaacagcaagagcagcttttaaaaagattgagcttaaaaagatgcgatggttgaaaagacctgaaaataaacgtt<br>tgatgaaaatcctattctcttttacctagcgaacagcaagagcagcttactcaaatcagagattccactgctaagtcatgagcgatgtaggctat<br>ttgcatagtgaaatcaatgaacgtttagcacgtcttgaagctcaaaccgaacttaaaaaatagaaaaaatgcttgcagaaattgaagataaaga<br>gaaaaactcaataagggcaaataa |
| Contig40_<br>gene_888 | 1134 | gtgaaaagccacaattagttaattttatagctaaagtgcttgaagattctgagttctgcttaaagtctataagaaacttaaaactcccaacagaccgt<br>agatatatatgcagtcttgccaacatcaatggcgattttgtgtatggcgatttgttgcatgcaaaactatgacaagaatgggaagttgaatcgatg<br>tcttaaaggaaatgaagttatcgaaagaaactttaaagcatcaaagtcttgtcacaagtcgtgtcaagcaagttctcctcacagcaaaagatat<br>gctgaagagagaaaatcaaattggtagacagaaacgatcttgtagccttagctaaaaaataccaacagaaaaaaacaagaaaatgaaccggt<br>aagacttagaagagaaagtcctgctaatatcgataggattcattcatgatagggttgaagccgtaagccgtgactacatagacagagtaaatggcaccc<br>aatatgatgccggactcaatagactcccaaatcaatccatatgactgatgatgacttgacttatatagggctaatcctaatagcagatcagaatcagtgggagga<br>attgacttaagcggatacagcgcgtatgatgactgacttatatcaaaccaatccataaatgtttcaaactgaatatgaaaatcaagcttta<br>attgattgcaaacaatcgagacccatatacaaaaaatacaaaatgctttatctaagttctcaagaagtcgtcagaaaatcagtcagtagaaacaaaagt<br>gcagcttaaatttcatatcttcaagaggatacaatgctttatctaagttctcaagaagtgcaagcgtaagtgcgcggttaaagaaatgattaa<br>ccttcaagaaatcttcatatcttcaagaggacaatgcttgttcaatcattgttgttcttatctgattcattcatactg<br>gccaatacttgaaatatcaattgtttcaatcattgttgttcattgttcttatctgattcatactg |
| Contig40_<br>gene_890 | 1135 | atgatatttttacaagcaatatcattgactttgtccaagattaactgattttctgctcattaatatttattcaaca<br>agcattaggattaagcaattgccacttgcttatgcgttgatgtcttattgcattgaggaaccctgtagcagttatcttgtatactctttagcgatatta<br>ttcaaatgattcaagattctttcaataagaggaatcattccaagaaatcagaagtcattcagaaatcaagaggaccctataagaagcttgca<br>tgcttacacatgccacaatccctgttggagtgttaggaatccattgacatgataagaaattgattgttcaaaacataacaaccaaagaagcat<br>attcttgctcttataacagatgtcttttatatgtatcccaagatgagaaccaatgactgtgttcaaaacataacaaccaaagaagcat<br>tgtctatggatgccgaggcaatagcttatgccagtcttcacgttcaggacccgatttattgcagactagacaag<br>gaattgctgcaaattcagcttatcctatcaattccagcaatcttagtgcgtcgtagtcaattgcttgaaagatcaagcggagcaataga<br>gattggtcatgttagttgatcttatcgtagcagtcagttcattcaggatactttcagaattgcttctgcttaagatatagagcttag<br>acatattgctactactatttgatagtagtagtagtagtggttggttgggagtatttcttttatag |

FIG. 9B-208

| | | |
|---|---|---|
| Contig40_gene_905 | 1136 | atgatgttaaactattttattaatatattaaatactaacattttattaaacctaaagagagagttattcaaggatttattgtttattct<br>aatgagtgttttttcctattattttatatcattacttagcaagccctaatttattttccctcttattctcttttgagcttttaatgc<br>tcttttaggataaatattcattacttttataccaattatttaatatgttagtttctgaaaatcctgttttattgagttatgagga<br>gttatagtaaacttattgtgcttaagtttaggagctttttagttttggttaagcatcgctattttcatcggtccttttattatgagtcatttttcatt<br>tgccttggcatgttattgcctctatgattaatgtttttcaggagagatattttaatgaaaaagcaaggtaatatctaaaaatcagacaagc<br>ttataggatactccctattggttttacttatttgatgtgtttcttttattcctttttcttgtcatgttaaaatcgtgttttttcaaag<br>ttcaattttttagcattaggcttaataatcattacttttaatttatttccatttcttattctttataaaatagtttaa<br>tattagaacaagaaaggcactttttattttattttttatcttgcaatcatcctcattcctcattcctcttttccaataat |
| Contig40_gene_912 | 1137 | atgttaaattaaataaaaaactatcattggaatacatcctttgtttattctgcaattcctcattctgctaggaaatcttttccaataat<br>tggagggcctatcattgccattttacttgcagttgcttgtgaagaataaaggaagcgctgaaagagggaataaaactcacctcaa<br>agtacatacttcagcttgcagtgcgtattcttaggattcggcttactgtttctaacctagggtcatatgaatccacaggaatccaatccttccaatcatcatt<br>ggaacaatatcatagccctatcgttgcctacagcgctgctacagcgcttaagatgaaatgtcttaagatggagagaagttgcccaatcaattcaataataattttctca<br>catttgcgaggctctgcaatagctgcaattatttccaatgcttggtagaagcttttctacagtgattgcttgcatatttgctgaactgcg<br>atgtcatagctgcaattatatttccagtaactgcagtctgcagtcacatgtggacaatatgtgggactttggttcagcaacctcgataaggcagctacagtcaa<br>ataaatgacacttcctcagtaactgcagtctgcagtcacatgtggacaatatgtgggactttggttcagcaacctcgataaggcagctacagtcg<br>attaaccagaagcttgcaatcattccaacattcatagcatttcttttatttagcttcaatcataacacagttgcagttttttcttgtgtggatgcaagc<br>tcagcttaaaagagcatttccaatgaaataagcaaattcctgattgtcatgcaatgcttgtaagcttgatttttacagcatt<br>ctattcattccaatgaaagagcatttccaatgaaataagcaaattcctgattgtcatgcaatgcttgtaagcttgatttttacagcatt<br>agtggaaaaccattgctgcttggtgcaagctgttggatagcgattaccattgtaagcttgatttttacagcatt |
| Contig40_gene_920 | 1138 | atgagcgaagagtcaagcagttcaagcagcagcgcaattatcctaatagaaacgttatctccgtgtaggaggatatctctaccg<br>cttttaatgcttccctttaggagcctgccgcatatgaattctcggacttacaactccttccaaggatcttccagttctctctgctgcag<br>ggcttccacctgcaattctcaaagtatgtctcgattcataatgtatctgaacatgcccttgctagcgcccaataattacaaactactatcacaagcctgagctcttcttcc<br>atggtattcctaggcttttctcatcactccttcagcgttatcgcttaatgcgttatcaagcgttatcgcttaatgcgttaccccttaagatt<br>attgcaggctgtagtctcatcactcctttcagcgttatcgcttaatgcgttatctaatgcgttaccccttgttctcttgattatccacccttgttctcttgattatccaccctt<br>ataccaagagctatcgaacagatattcatgattctcagtcgagtcacactgttctcttgattatccacccttgttctcttgattatccacccttgttcagtattaggttccgtt<br>ttaggttttgtagcatctgcaatcctctgcagtcgaatacactgatttctctcaattcctgtaaccgttgcagccctatggaccagagcctttagcatct<br>attgaaggacgagctgaagctggctaagacacttcctcctgctaagacttgcaatcgaatacttcctttccaatcgaatacttacagcagccctatggtatcacagtatct<br>gcacacttctttatggagcttcctatgcctgcaacatctgaagcatatgcctatcttcgcaaggaagaatattgtgacagcaccatataga<br>tccctgtctcaacaatactgcctgcaacatctgaagcatatgcctatcttcgcaaggaagaatattgtgacagcaccatataga<br>tggaatgttctttgttatcaatgtgtagaaatgaacatcttaggactatcctcgcaagaagaatatgtgacagcaccatataga |
| Contig40_gene_926 | 1139 | atgttaaaaatattggcagctgataaaatgacaaaaattaatagtcagatatataatgctcattgtagtgtaatcataatgtctatggggat<br>agcattatctatcaaagcaacttctttgttatttaggaacatcccctattcatctgtcctgtcctatcattgcctttcctgactgtaggagagttta<br>caatagttttcaatgcactcttgttattttcagatgtttttgcttagaaagatcaccatctccaaatagctcagatgctttatgcgtcctc<br>tttgatatatgattgacttcagtcttctaatacttaatttccaaatcctacagattatatcagccaatgcattctatgtcatcaagctgctt<br>tgtacttgcatttgcttgcttattgaagtaaagtcagatatcaccatgcttccagttgacgttcagttgtagccatcgctgaagttacaaata<br>gggactttgacagatcaagccatttttgaccttaccatcgtatccattgcagccatattggtattttttaggcaccttgagggggtc |

FIG. 9B-209

| | | |
|---|---|---|
| Contig40_gene_929 | 1140 | cgtgaaggaaccatatttgcagctattgttgtcggattaatcatccagttttatgacaggatatttgatataatattgatgcttatttggctgattag<br>atgaacttagaaacaaaagcattgaccttttaaatcattatcataatcgctatgtgtaattgtattcataatcattgcccttcctatgtgta<br>tgcttaccaaaaaattgccaagtccagtcatgaccgactatttctatttcttcatatttgaatttgataagcaatc<br>tattgctaaacagattttaaaaaggatctctcttagattccctaagacactataaaaattagcatacactaaaaatcaaaaagcttca<br>atctttgaatcctactcaagaaaagaaaatgattctgtcatgttttaatcgaatatgctgcatcatatctcttgccattattaacatactcc<br>aataccattattctcagcaacacactaaaaggctgaagctgcagaaagatatgctcgcatcatatctcttgccattattaacatactcc<br>ttgcagaattcaataggattcacattattattatacaagaaacataagcttttagcttctattactttacttaactgcctctatttttagctgcaatgc<br>gtgttatctatattaattcattatattatacaagcggtacagcaatcagtttgcaactgcgagcactgacctaaatccaataacctacaactttgtgtcatatagggccgcat<br>actctgcttgtctaggttcttgccatgcaatcagcaatcagtttgcaactgcgagcactgacctaatccaataacctacagattttcactcacaca<br>ttacattgaatgtcttgcatgtcttgcaatcagcaacacctttgcaactgccattcattaacatctacaatattcgacgcgtctcttcttgacttttgattgat<br>gacctaggtgtcttgtagtcaagcaacaactcttgaaggaaccattcaataacatctacaatattcgacgcgtctcttcttgacttttgattgat<br>tgaatgtgcattcaaatgctcttgatcggattcattttaagacattgcacagcattcaaaagcataagaaag |
| Contig40_gene_941 | 1141 | atggctaccgtagacagtttcctacggatttcatacaacaccctctttcaggatacacactatattcaatacagtcatctacactctaattct<br>tcttattttataatagcaatcataaagatgtttaagaagataaaatagacctatctccataatctatcatccatatctctttcttg<br>gatctctcatacgtgcattgtttgacatgggtctatcaacagaaaaaacagtcttcttaataacccctgccttacatactgttgccttataaca<br>attgcatcactgctattcagtctatttctataggactaaacattattccagtaatcattgtcaatatcagcactagataccacccttcaatcatagagtcaatattgtcttgatttcat<br>aaacataatcatgattcttttcaaggacagataaaactgtcaataatctcaactattgatacatctattacaatgttcctatgaaaattatagtcatcgttgc<br>aactacagcgaacatataatcgatcaatattcgatgacgaaaccataaaaagtctattaaaattaaccgtatttgtattaggattggcaccaggtttga<br>agtattataaaaaatctatataaaaagtgaaacatataaaagtctattaaaattaaccgtatttgtattaggattggcaccaggtttga<br>gaaactttttgactatgcaataggtgtatag |
| Contig40_gene_953 | 1142 | ttgagcaacaatcaaattctggttgttcttatgcctatatctggatgaagcgataatggctcattgaaacaagatttcaataatga<br>ttatgcatctttagcatcttaaatattcaaatattaatctttcaaaaataatcttttcaagggattcgactatcgcatccaataatgtgtattcaataactgaatattgccattgaggactcttccaaataca<br>atcagttcctatccaataacatccacgatatagctcttcattcaataacaaatccgactcatcgcatctgttttatacacaataataaatgttcagtcattgaatga<br>aactatttaggcattttaaagtataagctcttcattcaataacaaatccgactcatcgcatctgttttatacacaataataaatgttcagtcattgaatga<br>tgggaaatagtgattcaagacaatatgtgactcgcgcccttacgactataccagccttgcgcatcaaaaagattcaatcctcagtatta<br>acatagccaaattgcaggaacaatacaaatgactagctgtgtcttcaagtaggaaaacattcgacgaacattggactgtttccagcactgtttccagcactatta<br>aagataaatagctcagactcaatgatccccataatgttaagcatgccaaatgaaactatagtttggactgtttccagcactgtttccagcactgcttatggct<br>ttagcagggtaactgtaattgccggctccttagcaatagttggaattcaaatcaagcactgaaataacggaata<br>atggaagccaataataattcattttccacgaaagatcaaatatcctacaagcactgaaataacggaata |
| Contig40_gene_957 | 1143 | atggttaaatgttcaaatgtgggagtgaaaatagttctgaagcaaagttttgtcatagttgcggtgctaaattagatataaggaccatataa<br>tcttgatggcaaatcaagagatgttctacaacaggcaagagtgctggctctgctagcgcctattatgaccatagcgctaattcgtggtt<br>ccagttcagattccaccggagaattgataatttttagaaatatgagcaattttaaaaagatcattttgctgtgtgctgttttatagttta |

FIG. 9B-210

| | | |
|---|---|---|
| | | ttcatttgtccttagctgctcaagcactggattgatatgaacttatagcgaaataaaacgcttatcataattattcagtttgattt<br>agatgatgggcattatgctggaaagagcttgagatagaatattctaatatttcaagttcaaagatgagtgatatctttaaaaatccgata<br>agaatcgtaatcatctgataagaggcgctgagtatgatatgctgaacttatgtgagcattttaaagactgagcattgagaaaagaaaacgaa<br>aaacaagtagttccgttctagttctagttctgcggtagtgaagctgtttatgaactcgtataaatgccgaatgtgtagaacttcaaatccgatg<br>tgaaacatgtccgttctgcggtagtgaagctgtttatgaactcgtataaatgccgaatgtgtagaacttcaaatccgatg<br>atttagattaaattatgatgagggctattatag |
| Contig40_<br>gene_958 | 1144 | atgaaaaatgtagtaaatggttcagaaaatccagataatgctaaatttgtcataatttgcggtcaaagatttgaacaaatgaaaatat<br>ttgtcctaaatgtgcgaatccaatgtgaaggaagcaaaaatctgtcataagtgtggagctagctaagctctaattcttcttctggcagttcta<br>gttcttataatccactgaatgaacggtccttggtcgtgctgctaatgatataagcctgttctgttatgataagcctgttctgttctgttctgtgct<br>aatgataagcctggttctgttatgaatgctctaactctaattctagttctaactctagttcctagttctagttctaactctagttctaactctagttctaactcta<br>atctagttctagttctaactctaattctagttctaacaatctcttctaccagttccaataatcaggggttctacggcttcttctgctaatcaatctaattcaaca<br>gcctctaccaaaatcaatctaattcttctaccactgccaataacaggaaatgaaggcctgattaaagaaaatatgctgttgcta<br>tgttcctgttattcttttagttctttttataattttgcaatttcatttcagaggctagttcactttcagagctagttgttcaagcattatttc<br>accaattggacattgatgggatggaagattgtcactttcagaggctagtcagtttgatgactttcagatctgattcaagcattgacgaatttt<br>aatgaagctgataagaacaacaatggttatcttcagttcagctcatctcagttcagctcatctcagctcatctcagctcatcatccatcaagtag<br>ttcttctcatcaaattccataagtatcccagttcagctcatctagctcatctcagtcatcagtctca |
| Contig40_<br>gene_960 | 1145 | gtgttatcacgcagctcaatgaagaagcgactgtagctcaagtgtaactgctatcgcaagctatcatatatatatagcgaagtcatagtggtgga<br>tgatgatcaactgataaaactcccatgggtagtagaagcgaaagcgaaagcagggaagcaactgcatgagcaatgtgtcatatagctatca<br>aaacaggattaaaaattcccatgggtgatatagttgccttatagatcagatgtatccaattcactcctacaaagatagacaagataatcaag<br>cctatttgaagttgaagcagacattacaagaccaaattgcacggaaagttgccgtgtcacgagctgctacagagctatatcgcaacctcttttaagttt<br>cttcttccctgaattgaattatgaacagcctttaagcgtccaaatttgcaggaaaagcgttctgcacttaataaatcaaatttgaaaggactatg<br>gtgtgatgttggcatagtattggatgctgatgttcatgaaccatcattgacagagtgttagacatttgagacattcaacatgacatgtcttccctt<br>gccgattttaaacaaaatgccatcatgggattgtcccttatctcatctcatctcagtcttcatcagatcatcatcagatcatcatcactcttcttgtccatcatccatcatccatcatccatcattcagaaagggatacaagtacg<br>ttatatcagaatggcatcatgggatcatagcatcgtactgactatactagccttagaaatgccaaagtcaatcctattaagcaattttccatcgtttcatcctatgcgtttcatcagcttcacattccacattctatcagcagcaacatt<br>taatgatgcaggatatccagttcagtgaagcttactcagaagaacttagtcagaaatcgtactattggggatacaagttaagcaacatt<br>taatgatgcaggatatccagttcagtgaagcttactcagaagaacttgtatattccccttcagatgactatcatcaaa |
| Contig40_<br>gene_962 | 1146 | ttgattgcactttgtccttgctcctactgttttatcattgttcacttcttcgtaaccgctgctgcattggttattgtagtatcttaatgattgt<br>gcaattgaaagaagttgattgggacaatatggttgtagctgcatcatcatcatcatcatcatcatcatcatctttaacctactcaattcattcttag<br>gtatcgcatgggatctccaaatatcccgttggcgtctacgctgtgccatcgctactggcaaagctaaagagttcagttgattatggttaatggttatttata<br>tttgacatacgttcttcttcgtcttcggactttag |
| Contig40_<br>gene_963 | 1147 | atgttaaataaattttcaaattggatgaaaacaatactactgataaaactgagtttctttgcaggtttgacaaccttttagcaatgcttatat<br>tttagttgtaaaccaaccatgctttgctgaagtgaatgcctgcaacaggagtatttttcgcaactgcttcgttttcaggtatcttgtatca<br>tcatggtctgttccaaatatcctgttgctcctggtgatggtatgatggctttacctaccataataatcattgctatggtaac<br>acttgggaactgcacttgcagctgtattcgttccaagcataatctttttattaattaccattccgttcaaggagcatctaccgctct |

FIG. 9B-211

| | |
|---|---|
| | tccatttgacttaaattagcgattggtgctggtatgtttctcttgtttcattgttgaaagtgctggaattatcgtagcaccctg<br>ctactctcgtagtatggaactatcttatccgctcctgcgctttagctgtaatcgcatattgttacttgtaatcttaaaaaagtc<br>cctgcagctgtattccttgattggtaatactgcaattttagtgtaatctttacatgtgtttcgttcgtgctggagatccattaatgcctgc<br>cattcctacagagttcattctctttaattgacactctgtagtgagcattttaaaagatttcacaaggattcactaacatccctaacc<br>ttatcatgattttattctcattattattcgtacttacttcgttgtgatactactggaacctgatcttcttagcaaatcaatgtgttcgtgatgaa<br>gaagtaaggctgatgaattgacaaagcttcctggtgatgctataagcggaatcattgtgctatcttaggtactcttaactgcata<br>tgtagaaagtgcaacgtattggtcttggtgtagaacaggttaa |
| Contig40_<br>gene_966 | |
| | atgaaagagtcagattacaatacattgattattgaagttttttcgctattttttcaatcatcatagcattgcatgtttctagtatgcccaaagc<br>aaagtcatggcataaaagtatatatcattcatgtgtaaggttcggagttcctgttttataatgataagcggagctctctttaaata<br>gggatattgaaatcggttctttttaaaaaagaataaatagaataaacatatctcctgttttttcctgttacattataacattcatagca<br>ttgactaaccatacccatgaacagcaaaacatatttgctttcagatggtatttctgacaatctagtgttttattaagcatacctataataaa<br>taaatatattcaacattcatcattgaagaatcattgaatatcatttcttttcatcaatcatttcatcaatatctataactttactcttg<br>aaataaacaatatttttacttgcatttccataatcctatctcattgtctacatccataattggttttaggttattactatctctaaaaagactttaatctcagt<br>acaagcaagatgattgtcattcagtcatcctatctcatgctagatgtcagcttcatagcaagacgttaggatacatacctattcagctt<br>tttgttgccagccaatcagtcaaaggtatcttttccaccatacagtcatttgttattattattatacagccaatgaattaacagcagtcaagtctttttagc<br>gcatttatgaagcttcaaaaggtcattttaattactaatctcttgtgattatcattgtaatattatgtaaaataccatata<br>agctatgtgtatttcaataatcatctcttggtcagttgattatcattgtaatattatgtaaaataccatata<br>aattccctttgattctcataatcatctcttggtcagttgattatcattgtaatattatgtaaaataccatata |
| Contig40_<br>gene_971 | |
| | atgatattaggcacttatttaatcatgcctatttcaatagatgattaaggattgttcaattaggaagttgaatattttcttgctatttggct<br>aattacttgcattttgacaatacttattgatcggattcctgttacctgttacctactttacaggaccaataggcatggtggtattaggatatt<br>atttaagcatacggatagaaaaatattcaataactctttgataagcttcatatgtcatttgattgaatgattgttataatgctatgttcatat<br>ttcctatctagtccagaggatgtatgtcttgatagatattctattctttttagcgattgaagtagttgaattttcacccttataagtcat<br>tgataaaagagcttaaaatcttccataagaaaatgttttttaaaacatgctccattaaagtaaccttgcttttgtttgcacattagga<br>gccatgaattttattatgaatatcttcatatattaaataggattatcggtgctaaatag<br>acatcttggctctattggctctattggctctattggctctattggctctaaatag |
| Contig40_<br>gene_983 | |
| | atggataatcaaaatcaatgaattgcttttttattatcaatgattggagctgctgttggattaggcaatatctggcgttatagcta<br>tgttgttactcaaacggtggaggaactcttttttccaatatcttaaagagcatcaatcctaaattggaatacattcatggcattgtttaattatctat<br>ttgattccgccataaagactcttttttccaatatcttaaagagcatcaatcctaaattggaatacattcatggcattgtttaattatctat<br>tttgttctaatctattatctggtatagtaagctcaaacctctccaatatggcaagcttataatccaacaaccattccatggtcttagtgtgattgtg<br>ttcgtgcagaatgtcgaggaagctcaaacctctccaatatggcaagcttataatccaacaaccattccatggtcttagtgtgattgtg<br>tctggtacatctcccacaaggattttaaatgagggaataggaaaggcataaggcattgctgaatcctgattggcaaatgctttcataatt<br>gtatttgcattgaccctttcaggtgcaggtgcataagcatgggagagtcaatttcactgacatatgccagctatttgcctgaaggatctaaattgaccgaca<br>ggcctttcacagattatttttgcaatttgcgcattgaaggctgcacagctttgttgttttccaatgatttttcaatattatggtgctataggtcatataat<br>acaccgattggtagaattggtaaggcacaggacttgtatttgttgtttccaatgatttttcaatattatggtgctataggtcatataat<br>cgctccattgctatttataagcataacataagcttgttcgctgaattacttcagctgttcgagtagtgttgaaccgatgataa |
| Contig40_<br>gene_983 | |

FIG. 9B-212

| | | |
|---|---|---|
| Contig40_gene_988 | 1151 | atgacaattaaaaatatttcaaaacaagaaaaatcagtccaagaaagagattatgatagtgattactcaataaaggcttca<br>taaagaatcaagaattaaaaacttgcttaatgacaataaaggaaactattcaatcgtcattagtgcaattctactaatatcctttgatcct<br>ctattattgtgctgaacacagttttagaggaagaactacagacaatagcttcaaacaataaaagaccctgcttaactctcgtgatgactt<br>cgaaattacctaatattgagcgtgagcattggaagatgcagctgagcttatgtcattggaagataaaagaccctgcttaactctcgtgatgactt<br>aaaggagataatagatagatgaaaaactggctcaaaagaatcaggaatatcaaaactataattgaaataaactcctcaatcataggattgaa<br>acactagcgatccattttcctataagttaaaatcatcagtacctgttctctttgcgtgatgatttcaagcttagaatagaagactatagtcttta<br>tgctataatctaaaagatcagtacctgttctctttgaaatgatgattcctcttccaatcaaaagtattttatgccattcttggctaaattcctcagaagcatc<br>atgttgaaaactattcattctatgagaatgcaagctctccattattaataaaagatgccctagaccttatagcatcatgagatgacaat<br>ggaagatcatgaaactcagaacaatgactactacaaagccatgaagccatgaactagcttgcagctagcagaatctcagaagcaat<br>tgaccattatgctttgaacattataaatcctcaaaagaccaatgaaacggagtgtcagtgcctgcggct |
| Contig40_gene_989 | 1152 | gtgattgaaatgataaaatagttaatgactaaaatagaccaaaaggcttaatgtactcctcagaattgattctgtcctcattgattat<br>attcatcatagaatcatctattgaacatcctgaagtcccatgaattgaataatgaatttcctcccagaggcttctcctcccagaggccataagcatag<br>aaagtagattatctataaattaaaaatctgtgaaatggcttttttatgaagaaagcagtagtgatgagagataataactaactccatcata<br>ccaggacttgccataaataaaaatctgtgaaatggcttttttatgaagaaagcagtagtgatgagagataataactaactccatcata<br>tatcaagctcttaaagctcttaatagctctagtatagctatagctatagctatatagacaacaggtagttgactatcttagc<br>aatttgtgatatataggttcaatgacttggctttgagcttatggtgagaacttagaatctataactctcaataactaatcattactagttcctg<br>taatcatagcaatgatcgaagtattttttgctgaagattatatagctctaatgaatatgctctagaagtctaatactgaaagccttacttgaaagtctcatttcattttaaggttccacatgatgattgatttaa<br>acgttatgtagctatccataagaatatgactgatgagattgtatccaataatcagttgagatatgattatt |
| Contig40_gene_991 | 1153 | atgctagttaaaaagatgcttagagacttatctgaccataagattcaatttgtatccatctcccttatgcctttttaggcgtattcgccttac<br>aggaataaaatggagaagtgttggaatcacagatgtgtcaacacactactgaagacacaaatcttgcagtggttggatatgcgagaact<br>ttgataaggatactctaaaagatataaagacatgaagaggtcaagaatgccatagaagtgagtgtagtgataggtagcaactactcttcg<br>gaaccagacataactctccatactcgaagaagacaagagatcaaattcatctgttaaggaaaaagactttaatctaacgacaagga<br>aggaatatgattgacaagcgctttgcagatgccagatgcaagagacctagatattgagataagataccttaaattgatgaaagacagtgctaga<br>ccatccgagaattatatactctccagatatgtctactacatccaggaagaaagcatgatatcctgacttcagcaagttggctatgcattcatg<br>ccaagtaaggagctgatttgacatagaatactgcccaattcgttccaaggagacaatagtaggggtaagcacatgacagggtgattctcacagagaacacag<br>agagctttaggcaattttcccaattatctttgttatgctggcccttaacccttttccatatctcttcaaggacaaatgagcagggtgattcttcacagagaacacag<br>tgttttcaggaattttcccaattatcttgttatgtggcccttaacccttttccatatctcttcatatgattcttcctatctttgcaggctctcttt<br>attggaacactgaaggctatggatatgcctcacctcttcatcttctcttctcttcatctctcaggcaatgcaatcagcaatgtattcacttccat |
| Contig40_gene_993 | 1154 | atgaagatgatacgtcaattcgggatcctccatgcctctcgttctgtcgtcaatctaatactgttttattttaatgaatataacatattaccct<br>tcctaatcgtatttatgtctataaagctattttagaagatactgcagtattaaaggaagcctgattgctcttttctatctgtctgtag<br>gggatttatgtgcaggtatcattttaggaaatatgaattcttcctaaagcctatccggcttatgtaatgaccatcattccaggtcatagggatg |

FIG. 9B-213

| | | |
|---|---|---|
| | | agggaaacatctttggctcttttggctcaaggctagcacacctcacattggtactttgtctcctgaatttaaagatcagagatacttag<br>cgaaacattacagcatccctattttgactatggtactatccatattgctgctgtaatcgctaaggagtctgcatagcctttgatttaaaa<br>gcataagcatttatgacttgttcttattcattattgcaggcttatttcaactatcattatgctgctattacaatgtttatctcacttaag<br>agctttgaaggaggctggaccagacaatattacaactccattcattgcagctgttggagactttttcaccctttccagcaatcatattaagcgt<br>aatcatagtggattcatttccataatccctatagtcaagatgattgtcttttgtagcgtaatatttgttacaatagcagcattgattgcaggat<br>acacagcaaaaagcgatgtaaggcatatttgtaaggcaatccactcctgctactattcattgctcactccttgaacattgcagttgaatattg<br>aatgattcttacaaccttgcttaagaatcagactttactcactcttgttccactcttctcaggtgaaagcggaggattgtaagcatattagg<br>agcaaggctatcatctgccttcactcagttcttattgaccagtgctcagacctcagaagcatacagtagaga |
| Contig40_<br>gene_100<br>3 | 1155 | atgttacttacaatcttgctattttcacttgcagtagatctcttctcagtggtgagttccaatgcagatacatcctgtagtatgattgaaaat<br>aataagctttttaagaatatcctaatcaatacgacaataagatagctggatgatctctcaattgctgtaataattgttcatcacttattg<br>ttctaatccaatgctatagcaagtatctattgccatataatgatatgattatcaagctgatagcgattttgctcttcacttca<br>acattcagtcaagctgttgttgattctgcccgtgatgttgaaaagactaaggaacaataacttaaataaggcacgtcaggccgttagcta<br>tctggttagccgtgacactattgaattgaataagcatgtcatagctcgctgtaataagagactctaagtgaaaacatacctgactcctatgttt<br>caactgtattctactattcaattgtgaataatagctagcttgtgaattggagactttgatgtcataatacttgctgttctgctgcattt<br>atccataggttgttgatacaatgattccatgtaggatacaagactaagaactctacaatatcgtttattccagcgcalttgatgatgc<br>tttaaattacatacctgcaagttttctgagctttgatgttgtatctgctatgttctacgtttctagtgaacacattcagctagaaagaggagtt<br>gaaggatgcaaacaattgtgacagtctaattcaagatatacagtgcaacagtaaggcagtggatctcagcaagactgaccatatttttagttacaatatt<br>tatacctagggatatataaatccaataaatgttgattgcattgaaaagactgagtctagcaagactgaccatatttttagttacaatatt<br>cttcatgttgtattatgatttaattctttaatgctttaa |
| Contig40_<br>gene_100<br>7 | 1156 | atgcttaaagaaagatgctaagagatgttgaattataagagatctaaatttcaattatatcatttcatttatatccattcatagcgtatttgtatttgc<br>cggactgactgactttctaaagcaggtctactgttgagcctcacttactgcttgcgcaaccacatctaaatatctcttgaaggcaatgcatattagctagcgatgatccaagctgaattagatggc<br>ttgtgatgacttctaaagcaggtctactgttgcttggcgcaaccacatctaaatatctcttgaaggcaatgcatattagctagcgatgatccaagctgaattagatggc<br>aagcccgatatacggctcattttgttgaaaacaacaccatctaaatatcatccttgaaggcaatgcattgaaagcaatgaatttaaatagaaagaga<br>tgatgttagataaaacttcgctgatgctgaagatgttatagcttagtcccactcaaacagttccaaattatacgcaagggcttgcttatgtcc<br>ttaggggattagctatcctcagacaatataacttataatgttcttaatgttctaatcaatctagcgtaaatgcgtttcagattcaatgcctctcatcaaagaactcaataactcggtgtt<br>tatagatgcattccatgatgaattgtaactcgcccaatcaaaaatcaatctagcgtaaatgcgtttcagattcaatcgctcatcaaagaactcaataactcggtgtt<br>cttaaggctaatgatttagcaataggtcaatagtcatcactttgcttttgcttttaagttccctgtttgctttaagttcatacatcaggtcaatataggtgcaat<br>tttagggcgatcgtattcattcgttgttcatgatccagaattattatttttaagttccctgtttgcctt |
| Contig40_<br>gene_101<br>2 | 1157 | atgaatcaaaatgccagtgaattcaattataacattatattggcaatgattggcttaccataggcataggaatattggcgtttcagcta<br>tgtattatactctaatggaggagatccttcttcatacctattttattgcaataatgttatggaattccttttgattttagagtatgat<br>taggctttagcctaaagagagtttttcaaagctgatgatgatataccgcgaatttgaggtaatgcttgaggatgttgtcatattcgtattc<br>atcgttgtaattactatatggttatcatagctgggatttgtatattcctaaacagcttactacattaattgcacaacagtcttatgattatttt<br>cttcatgacttatgtggtgaactaggagatatccagatggaaggctcttcttctctacacattaattgcacaacagtcttatgattatttt<br>tttggtttgtatcaatcgtgatgtggatgtggaatcgaagaatttcaaccattctaatgctttgctattttataataatgatttttatcttt |

FIG. 9B-214

| | | |
|---|---|---|
| | | ttatactcattcacattgccaggatttgacattggaataagacattgcttaagcctaattggtctctcttcttttagacattcacatctgcttgc<br>agcattcggacagacaatattcaccttaagcatatgcaggcaatggtctctatacctatgcaagctattgcctaggcatatttgcctaaatggtcgatg<br>aagtattgcttgtggttattacaaacacccttatatggagttttcaatggttctttcaatacttggatatatgtccctaaagtcatca<br>atacctatagaaaaactcagtgaaggactgactgatatttgtatttccaaagatatttagtgagatggtttgtaggtcagattat<br>agtgccattgctatttttatcaatactattgcaggatttacttcgcattgttactgagccttcctat |
| Contig40_<br>gene_102<br>2 | 1158 | atgaataaaaatgattgaatatttgattatagacaacagttattatttcttcttatttgtctatctcttattgattatcaatccaacgg<br>atatcagttttcgtatgtgaatgctactgattcaatgaatatctcgtcctcaagtctgcctattcagtcagtcgagcacagtagaattta<br>gaaatgattaaacagtttctataatatgacgttagcaagctagactgctatgtgctatgtgaagacgataaaggattaaatcataccattccatgat<br>cataagtccgtacttcagattgataaggatagtttatccttaatgaagaagcaaccgtttatctattgatgaaacaataggaattgtgtag<br>tatctctgtcgattcatttgataagtagttggtaatatga<br>atactgtatatgaagtcaggtggtaatatga |
| Contig40_<br>gene_102<br>3 | 1159 | atgagtccatatgaactgataaaggatgatggtgaagtggtaatctggttggttctcctgatgagtcaagatttgatgtttcttagaaag<br>gctaaatgataaatcttagcagattcagatggagaagcatgagcgatggaaagctattgatgacgtattcatcagctattcaactaaaaactcagatatagcaaatgaga<br>tatgctacctttctgaaaagaaacggtcgtttagtatattcaaacaggaatccacaggaataacatccaaatattcatctgcaaaaattatgttgatgagatagcagatgga<br>atcaaatcaactaaaatagtcgtttttagtatattcaaacaggaatccactcatgacattatgggatactattttaaggtgcctcaatggctgccggcatatccaa<br>taagcctattatttcattaatgtcagtatgagacatggtactgacgttactgaacattaatgcaatgaaaggccaagaactgtaattacaagctagacgcgcttcatt<br>atcctaaaagtcagtatgagacatggtactgacgttactgacgcagtttaaaattatgtcaatgaaaggccaagaactgtaattacaagctagacgcgcttcatt<br>ccagaagacatatccaagcaaagaaaaatcatgggactattggttaggattttatttaaggtcttcaacagtaatcagtaatcgattgcttgtatttccagtattaccagattat<br>ttcaagaaaaaaatcatgggactattggttaggattttatttaaggtcttcaacagtaatcgattgcttgtatttccagtattaccagattat<br>tcctattttatccgatattctgttttagaactgtttaggtctttgataaggatctttgagtatctttatgtatgtattataaaatgtaa<br>ttaaccagatattctgttttagaactgatgtctgttgataaggatctttgagtatctttatgtatgtattataaaatgtaa |
| Contig40_<br>gene_102<br>4 | 1160 | atgagtcatgatgttttatatgctatgatgaggaagataaagattgtgcagagaggccattgccgtatctttgaagagaataattaagactgg<br>gattcgctcaagagaacgtatcttcaaaggatgcagccgcaatctaacagaggctataagaaattccaattatactcttaagctttgatgagacaagcatt<br>atgaaagaacaccaattatattattaatagcaacagacatagaaacaaagaagatagtggcatatctcatagcaacaagacaattaaagactcttgtaaaagagacttc<br>ccaaggatttggaatttattttattaatagcaacagatgattatgcttgattctaattcagtcaagacaattgaaagtctaatcctaaaagaaagaaaacata<br>agatattagatagataccaacagatgattatgcttgattcttaatagcagcagtttaattttatttgtaatagtgctacaggccagaacatcaccgat<br>taaagaaagctattggacgcagcggcttgtaacccatgtgaagtggatgaattggccaaaggcaataagtatacgataatgcgaatcatataattgcc<br>agcggtgtattctccatgatagtaacctttatgaaccttcaattctttgatgataagataatgttttatgaggtaaattcaacagccgatgagtttaaat<br>aagtgattctgatagatactttggtgataaaaagttattaactgatatgtaaacttgagttttaaattaactgatatgataataaaatactctccaagag<br>caggcattatcttggattgtag<br>gattataatcttgattgtag |
| Contig40_<br>gene_105<br>0 | 1161 | atgggtttgttaagcctcaccattttccatttaacaatccgcaaatggagaatcattatggcgccattttagaaatgtttagaatgcttc<br>tgtagtcttgattctaacatacatagccaccaatccaaagtttaaagttatataacagaggccaacagtccgtaaaaccatcatctggcaga<br>ttatcatatttccattctaggaattcttgcatcatattgcactatgatgtaaatggaatccctgcaaatgcaagaggattgattgtaatgata<br>tccgcattgcttggaggacatatgttggaatacctgtaggaataatagccggattctggatatagcggattgcatgggaggcatcgctggcatg<br>tggcgttgcaacataatgctgaagtgtaggaagtctcgtttataggagatgaacgatggcaatgaattcctaaggccataagcatcctgttaa |

FIG. 9B-215

| | | |
|---|---|---|
| | | tgcttctatatagcggctttgacatgtttctaataaccatattaaccctcaaccaaaggagttcttattgtgcctttatgctccaatg<br>acatttggcgtgttcttggaatcttactcttcacctattttaactgagaaaaagagaagaagccgaaaaagcgatgaacaaactgtttctga<br>caatgagaatacagacacacagaatataatgaaatctcacagaattgaatgaatataaagataaagttaaaagttagaacagaaactagagg<br>aatacgacaaaaaatttaatcaattggaacagaatttaaagggacaaataa |
| Contig40_<br>gene_105_<br>2 | 1162 | atgaatgaaaccattaaggagcacttgattccctagttcctgtttgttttgctacctttatcatagctttgatacaacattcatgaacgt<br>cagcatttcctcagttgttgctgacttgaacactgttgagtgaacacttcaaacatctcatcattctatactctcactctcatcactcatcatgc<br>tcttaagtaccaagcttcaggatatagttgtaaaagaagctcttttaatcggtgctgaattagtgctgctgtcgtactcgtacgcagcatta<br>agtgccaatactctaatgtattttatagatggcattgctgaagtatagacgactgttgatgacactgcagttcatcataagcgg<br>aacctatcaggtgaaaagcttacattgccctgtaaacgcactgttcaatgacgtttccggacgcagtatgccgcctcttcgtgggtcg<br>ttacacatactctcacttgagattgagatttgcagtgaatttataatctcattgtagtcttgtcactctttgaaatcaaagaaaagcaa<br>gctacagatcaaaagcgaattggacattacagctgctataatcttaagtcttctagcactctttgaaatcaaagaaaagcaacg<br>tgataccacttcagcatagctatatatgctcaagataaaagacagaaaatctcgtagtactctcattgttcctgtgttacctgtgttgtattg<br>taccgttgcttgatgtgaattattaaaagacagatgctatttgcctaatctgttctaagctatctcacaacagtttgacctcttgtaacagattgacgcattaggttgtcctgtcttagctctcttggtctctcta<br>tgcattgacagccccaaagctattgcaaaacgtatctgcaaaactctgcaaaactctgaaccacaagatatcatgtcaatagatgtataataatcaa |
| Contig40_<br>gene_105_<br>3 | 1163 | ttgaaggaagatacggcctcaatgaagagattcgctccgcgctttagatgaggcaaaatcacaggaacaaacatgcgcgttctgtatgtgc<br>tatggtgattggcatctgtaaggctcaacatgaccgtcaaactgcagtaatcatcggtgccatgcctgattcttctgatggaagcattctgcct<br>ctgcctatgcaagcgtgaccaatgaccgtccctcttcttggaaaagcactctaaccgattgcaatcagattataataagcgtaactgcagcagcc<br>actcttcttttccctccttcccagttaaggagcaacagagagattgctagaaacatctccttcattttatgatgtgtaatcgcattcttcgg<br>aggactgcaggaatcataggacagaggtcagataaggtaagcacagttatccaggagcacagttatccaggagcagttatgttattaaccctgcagtatccaggagcacagttatgttgttccgttatctcacggaaccctatccaggagcacagttatgttgctgcgcccta<br>gtaccctgcggttattcaattgcaaatgcaaacggaagatggacatgcttctaggagacatgcttattgttttgttttaatctgtatttcatattcctcta<br>tcaagcctattttaagtgcattgaagattccaaaattgaagagtacagaaaaagaatcaaatccataagtggaatgagttacgaat<br>actattttaa |
| Contig40_<br>gene_105_<br>6 | 1164 | atgagagacattgaagaacttaaaaagacacaggactgtcacttaaaagatatcttattcttttattgcaaatcttatcgattgtatctaat<br>cagcttggattggattcacgtcaccgtcacagtcagagtcatataattcatatttttcataagcatcttcaatgcagcacatatggcctctgg<br>taacaaggatatacatgcccttatggtttggacctttggaatcggagcactcctttaaacgagggtgtcttgcttcttcggccatactttt<br>ggcttagacatatcaggatggggaatagtcctgccccattaacaattgccttattacaacattgccctatcaacccttatgacgctgaggatga<br>tgcacatattatgactgtcttcttcttgaagctgtagagaagctgtagagaacccaagcatcaacactgtcaagtcaatgttgacaacaaaaccatatcctaaaaa<br>ggcttgcatatgacgtgcctcttccctcaaacggcgcaagctgatgacctgtgagttacaaaggtaaaaggttcttgaagagaatatcaagactgttaacgcttgttgtgaa<br>gaaacaacaatcagatgatgcagtctctttcagggataccgaattcgacgatatagtaattcttcatattcagcaaataacagacttagaagcttacaatggc<br>atgggcaagcagatcaaacctctttcaatccaagcgaattcagcacgtatagtaattttagtcatagaagacatgtccatgagatctcatattccccaacttaa<br>gcttgttttcatctttcaatctaatatccgtccaagaattctcaaggggcatcgcatactattcaggcaatattcaccttgacgtacacaaggcccgaacaaatg |
| Contig40_<br>gene_107 | 1165 | Atgttagcccccagattaggattaatatatgttttaggattttaggattgtttaggattgtgtcgcattggcaatcgtgacattaaa<br>tttaataaacggattcacacttatgaaacactgcccttttgaaatattcaccttggagtctcatattggagtacaggctttggtactctggat |

FIG. 9B-216

| | | |
|---|---|---|
| 7 | | ttaaaacgatacaattacaaagccaaactagataacagctaccacatctccctatttttagtaagcatcatcatctgtgatttatctattca<br>acagtccaaggaatctcttttaaccttatattctgggttgatagatttatataatgatcctctttattttcatgagcttttaccacaatgccatt<br>tctctatgaataataggcatttggatctgcaacagatatgattgtttcgaacaccaaaaaatcaaaaagacatgttgacaagagaatatatc<br>aggcaatattctgcataatcatcatcacatccaatcatcagccacatcatttataactactgatgtacaacggtcgaatcatagagttgata<br>gtttgggaatcttcctatttgcctctgacaaagccattcgaatatataacaccgatgcagctacaagtcatatagtcaaagcgataacgtctact<br>gaattcattataatcacattatcctgagtttttgggaatagcaattctcatgacacagtcgtatacagtgcatatagtcaaagcgataacgtctact<br>tagtattaatgtgggacctataaccgataacgtattgctcctgttcctcattcctgcattttatctttaagatatattgaagacaaagta<br>gttcagctatcatcattttccaaaatgaagacacttgccgcctcatataccgaactgataaagacaactaacaactata |
| Contig40_<br>gene_108<br>0 | 1166 | atgcagtaacatatgcctatttgttgatgtttgattgtaagttttttaattggagccagtaatctgtcctattcagatgtagctccagt<br>aatcacattgtcaatcttatttattgatgatcggattgggaggaagcgtcctattgttctgttcgtcaaaggcagaatttgatgatgaaaaagca<br>atagtacttttcagtatcaatcatatcctcataccagtggtatttcattgattacggttgattacgttatagactcttgttttcaggaagcattgcccagttc<br>ctatgctcttcacagcctgaattggttcccaagtgtccaatcttcattgcttgttattgaatgcatctcattcttatgttatatgatgagctt<br>atcttatttcataaggcgatggtatcccccaactgccattcagggctatactatagcaaatattgtcaatatttgcttgacattattaca<br>ttaagtttttcaattgggcctaatttataaaattgaaagctaacgctttcttttaaattcattaaaagatagttacttcaggatttcttctgcctcaac<br>aaggaactacttgtctctattgcttgtcataaactttttagttggccttcacgttggaagtcagggttgtcgcattgtttgttata<br>tcaactctatctgtcatatattgctgtcataaactttttagttggccttcacgttggaagtcagggttgtcgcattgtttgttata<br>acagtctgtcatatattataaagagaccccggcagatgttcctgtagtattgcatctgggaatggaatggaaacagtaatgttatg<br>gttgactatattataaagagaccccggcagatgttcctgtagtattgaatgcattgagaatttttgcaataagttatg<br>cttgtatagtgttaaagaccccggcagatgttcctgtagtattgtgaaagatagaaagatcctaatattgttgtaatattagccatctttaacatagcctttatacatcaa |
| Contig40_<br>gene_108<br>3 | 1167 | atgtttaacaactataaagacaaactgaccgagatagaaagatcctaatattgttgtaatattagccatctttaacatagcctttatacatcaa<br>catattcaaggtatatggttgacatcaaggacataaacatggcggtcacacgacttgtcacatcaactgtcaatcatcatcctaggattta<br>cttcaacaggctcccaatcttaaaagcgtgacagttcaattatgacagtcatctctatcatcatagccatcatcatcatcatagcataaccattca<br>ttctttaacaagtccatcaatgggaatcattatggctcctatttggaaatgttcaggatcctatctgtcgtcctgatttaacattcctagc<br>cactaaaaccaaaagcttaaggcgtagtaaaggggagaccgcttccagcaatcatccacagataatccatgttcagtcctggaatcc<br>ttgcatcatatttcacaatggacatcaacggcttccagcaatcatccacagataatccatgttcagtcctggaatcc<br>gaatacctgtaggaataatctctggagtctggagatatcaaggaggtcctacagcattgcatgcgccattgcaacaattctagccggaat<br>cactggaagcatcatccacagatgaatgggaatgaattcatatcccagtcaaggcagggcttttaatgttttttttacagcggcttgagatgt<br>ttctgcttaccatattgacccagagaaagacccctgcaagcaatctcatcgttgcaagcaatctttatgcccgatgacatttgcagcagtcctggaatccta<br>ctattcagcctattttagatgagaaaaagaagagaacgaaaccgataccgatactgatgatgagatgaagataaaagataaggttgaaaagc |
| Contig40_<br>gene_109<br>5 | 1168 | atgaaactaaaacctaatcatatgtgttacattaattcttgtatgcctggcctatttctcatatcccatgacggtcaggaaga<br>acccatataaccattctaacagctccaatcctaacaggagacacattaaaactaaagctatgcgataaggatgaaaggaatagccgatc<br>aaaagattagcttaaagatccaatcaaaggatgaaactttaatgacgatatagtcattaaaacagatgagaatggtgaagcaaattcaaaac<br>ctgcaaggggaaattatactctcatagccaatacgatgaacaagccaatatgaacaagccaatatgaattaaccatattgatacgcatggctatgattaaccttaggccctaa<br>ggaagttgagcaaagctctaaaaccactagcacaactacaacctgccacatccaataatgactatgcgagtgactatactataggcatatgatgtta |

FIG. 9B-217

| | | |
|---|---|---|
| Contig40_gene_110_7 | 1169 | tagatggttgggatccttcagaacatgaggtttctagagagtatttagagagggtgagtatagagtcaattatgatgatgatattctagagtg<br>attgacagtgatgaaatgttaagctatgatattag |
| Contig40_gene_110_9 | 1170 | gtgctttataggggctataaaaaggaatggagtttgaaagttccagtgcattattgttgttgcccctgtttattgcttgcttta<br>tagcctatttaattaa |
| Contig40_gene_110_9 | 1170 | atgttaaaaaattaaagattattatagttggtgatagatggacaataaactattttacaggcattagcaaattttcattgcctaattat<br>aatatgccacttcttttatccgctgaactctcaactaccgaacgatgctcttatagcattatactcctcatccaatgttttttgctg<br>gaatcatcatgtttatcaaagtccagagcttcagagctcttgcagggctaaacttagattcgatgttaagctcaatagctcaatagctatcttaattagc<br>gcaatcatcatcttttcttgcttttattctgcatatatcatgtatgcgcatcctatgtatcatcattgcttcagt<br>catatttctcctgcatatatcatgtatgcgtcatctataatcatatgtcgctctatgtcatctatgtcattgtattggatagcatattt<br>ttgacacaggactctatgctgattatccaataatcatatcttttagaataaaaacgaagaaaagtttttagaagagcttgatgtatgtgga<br>tcattataagtcatgctgattatccaataatcatatcttttagaataaaaacgaagaaaagtttttagaagagcttgatgtatgtgga<br>gtatgaaaaagggtaaaatatagattaataaccatatttgtgtag |
| Contig40_gene_112_5 | 1171 | atgaaagtatcagtagtaacacctaactatatagttgtctaaattcttaaacgcctatttttgaaacttagcttttcaaagtaggttcatagaaga<br>gatcatcataatcgataatgcatctcactgatgccagctgtgatctgtacagctgtcctagctatagattgacataaacatta<br>taaaaatgataaaatcttggatttgctcctgcagtcaatctcatcaggcattcgcttgctaaatccgaactaatctattcttgtaacaatgatgta<br>gaacttgaattaatactataagaacattaatcactctatggaaagatccatcttatcctatctcctcaactatctcagcatcagctatctcagcatgatgat<br>acagtaccataataagagctaattgatgatgcagtgcagttgcagtgatgcatcctgtgcagtgctgcagtgctgcaatctcagtaaatggtctgcattgaaatatccattttgagaaataggtcttttgacgataat<br>ttctttgcttatgtagaggatatagatcagcagtataatcagtgcttaagataaggcttggtgatgttttagcattttatactttgatgttggatgatttaattaaggatttctttattttcaataaatatcctctttttaaggaaagattcggcttcgcaatctttgg<br>gctcaaagattgttaatttcatcttcatattcttgattcatccaacctttgaatgaacagatataagaccacttgaatgaaaagcagaccatcttcatatctcttttaaggaaagattcggtctgaatctattgcgc<br>ggagtgctacaagcggaagcaagttataatgagttttaagataaggcttgctgcacgaaataatgtttgataagaagattcggtctatctatttggc<br>gattaagaacacacattggctacttcagtcttga |
| Contig40_gene_112_6 | 1172 | atgagaaatatagacttatcaattattgttgttaattataacacctttaaattaacaggacactatagattcttgttagctgaacctactca<br>ttatacatatgaaatatttccttgtagacaacaaataacagatgcagacagatcaacagaagcgaacagaagcgaagaa<br>tattaaaatcattccaaaccaatccaacgatgtttgcaaagccatcaaatatattgcaaatgcaagcaagcaacaaaggggtttcatactttta<br>aactcagacaccccttatgaagcaatccactatcgacaagtgcatcgattacataacagacaaaggccacgatgatatagatgcattaggctgtaa<br>ggttccctgcccgatggaagtcttgacaagtccgcagcgagcttccaactcctgcaaactcccttatatatatgtttcatataatgtag<br>atagtgacaagaacgattatatatatcgatgatcttgatgatgttctcatgtagagagatattgatgtgctatagaatcaaacaggcaggatggaa<br>actacaatcgatgaagtaggcctttggatgatgcttttcttcatgtatgggagcaagcagcgagatcaaaaatactaaaaaagaaatcaaagatttattat<br>agtgttactttcggccaggcaggcagaatttcactataaggagccagagcagcagcagatcaaaaatactaaaaaagaaatcaaagattatttatg<br>agtttataggcaattgtatgttctttttataaaagcactactaaaaaatataattcctttgaacatctgatctataattgggaagtt<br>ttgctagttttttaacttagttagaaatgcttcagtcttga |
| Contig40_gene_112_9 | 1173 | atgattaaagaaaatcagaataaatgcaatactagtcattcatcatagacattattgtaattcttatctcactagcctgcatcatttgtaag<br>attcaagaccaccatattctcagtaggaggctcccttccattcagtgactactattcagtaatcgtttgcataattcctacttatctctat |

FIG. 9B-218

| | | |
|---|---|---|
| 7 | | tatactacttctttggtctttataagccattccgtaaccatcatcatcaatattctctggtgctgaggacattgtaagtctgacataatgcattc<br>atcatcctggttgctattttgttcatcatcaacagcctaactttcaagatcatgctcttcttgaatgattctcacaat<br>cgctgaaagggtattggtcttcttgtattgagaatgatgagaacaaacaacctaacctgaagcatatgcttatcatcggagacaatgactgg<br>cattcgagttgtcacataagatcaactctaaaacctattgcctcgtgtcctgttctaaagaccataagtttgacaagttgcaaacgattt<br>gaaggaaccaagttatagacgagctttgatgactgcatgtgaggaaggaatcaaggcagaaatcattccagactattccaatgtatcctccggctaagc<br>ttattaccatctaaacgatcgttgatgacatgcctataatcaacatctccaatcatgattttaactgcaattgcaattaagattgagtctccaggacctatcatctt<br>cacttgtatccattgtagctattataatacgtaagcccttcatgatgtataagttcagaagcatgaagttcaggatg |
| Contig40_<br>gene_113<br>0 | 1174 | atgttgattgctatggactttagaataatttagtaatcaataatatgctctaccttgtctaatttctaatgtcttataacactgctgatgtttccttgcttc<br>agaagatgtcgaaacactcaataacttttccactactatccactagttaatcgtaggagtattcacttatctacttaaatttatttgcttgggataat<br>catctttgagtatttttaacactttaacactttgtaacagtggtcttgggaaatacaaggtttttaagcctatccgattacacagggatctatgcagcgaagcct<br>tatacgtcagtctttctgtgactgctccacctcaatgtctccattatgtctatcgttaatattgagcgttatctctttaagcttgtaatattgagcgcttgatgtaacagatgcggaact<br>ctttaagaaagatagctactttttgttccattatgtctatcgttattaggaattctcttaagcttgtcctgattatatattcgccattccgataacagatgcggaact<br>actgtagttggttattggtgatgcaacttcattaagcttatatattctccctttgtggctttttaggggcttttttgagcttttcgcataacttatatatgcctgctttgatcatcata<br>ggaagtgagtcttgcctattgaagcggctatgtcatcagctatgattggcttgtctttttaagccataacttataagttgatctcattgactcagattgt<br>catcggactattgaagcggctatgtcatcagctatgattggcttgtttttaagccataacttataagttgatctcattgactcagattgt<br>atttttacttcgactttgttggctagtgactattccttgtttttaatgttttatagttta |
| Contig40_<br>gene_114<br>4 | 1175 | atgaacggaatatatattatgtaatagccttctactttattgactattgcaattgtattaaggcagacttgaaattatgcctgaagt<br>caattttcccctttgatgtgaagacacagagattgagaggatttatagacagaatcgccaatagaatcgctctctaaagacctgatggacgctcctaagcagc<br>atataggaatcgtcatctctactgatttatgattctgatggctgtggccttggtatctctcttaagacccctgatggacgctcctaaagcagc<br>ctggttattccaggggtgaagtgccaggatgccagatcccaatatcatctttcctatcggtctttctatatttgcaattcttccaggagctttgtagagc<br>gttcagtcatgaatattggcaaggtggaagggattgaacgtcctcttgtagtccctgcagtctttgaggatgacgcattgtaataagacggcttactgaagacggcaatgc<br>ctgttatcatgatgctcatatcctctgagggaatggtgataaaggaataaacaattattccgtaagcgatgggcatcctcaaaacagtcttaggatatatgga<br>gccatcaaacgtgactgttctaacgatcaggagagtagcttcaaatgaagtcaaatcctcaaaacagtcttaggatatatgga<br>gttcaggcacagttaatcaaataattctccggatttgataatagctccacctccttattatgggaataatgtcttgacagacttatt<br>gttctgatatacttctgaactttgctgtcggcacattcaacctgctccaatgaagccattggatggagtc |
| Contig40_<br>gene_115<br>3 | 1176 | atgaaattcgattcagagacatctgtattgcttgtatcattccttacagcattctttgcagtgtttttagctgcagtatagtcatagaggttcc<br>agcaattgcaaatgagtttgaatgaacaatagtgttcaaaatggattattacaatgcatattgcttgttgtagcttctacgctttctgctg<br>gacagttccggtaagttcggtgcagttcaaaagttcttgcttgttgagttattaatcttatcgcgttcaataggagcatgctgttttct<br>gccgaatcattcctcttcttaggtgattcaagaatcgagggcattctcaaaatgccatttcaaaatgccatttgcttctatggtcgttcagcaatcaagcc<br>acaaagcagaagaaaggccctttggcttactgactgtaactgggttacttgtcaggatccctttctcctgtaatatgcggattccttgttttataact<br>ttggatgagatccatgtttttactttacaatccattcttcctattgcttattggctaatgcttgttgaagattcaagggggattgaaacctat |

FIG. 9B-219

| | | |
|---|---|---|
| Contig40_gene_115_4 | 1177 | gaaatgataagattgactgactctataggatacatgattatgcagtggaatattgctcttcatctatgatttacaaactgataaacgcttggg<br>tttgatttgtgttgttgttgttaggctttatattgcttcttgcttctgccatatttgcatatattgaaacaagagtggacactcctgcatttaacatgagattgttta<br>agaatactaagtttgcatcctccaatgtctggctctgcgcattatgcagctatcctgcagttgcagcactcactaccatattgaattatcatttccagtat<br>gtaagggatggaacgctcaaaattgcagctattggaatgaccattgcaactgcagccctagtgatttttgatatttct<br>taggatacatcctcaaaattgcagctattggaatgaccattgcaactgcagccctagtgatttttgatatttct |
| Contig40_gene_115_6 | 1178 | atgaaattagatttagaaacagttgtagtggcgtatcgttcttattactttcattttttgcagtatttttatcaaatgaattgtcatagggttcc<br>agctattgcacaagagtttgcaatgaataatgttattcaaaactggttcctacaatattcttccttgtggtagctatattacagttcctgcag<br>ggcagatacaagtcagttaagttggtgttaagaagtcttgtgttcagagagtgctcttgtctacctcttgctcaatagggctgtgcttcattcctc<br>actgagtcattcctcctttccgtatcctcaggtgcaggggttgcattcttgaatgtgctgctatggtgtacatgcagtaagcc<br>tcaaatagggaaagcacttgattttacagtacggtatcctcctccttgttttatttgctacatcattgtctctgtattgcagccagt<br>tcggctgagatcaatgtctactcttgtaattcctttcttggtactcatttgctctctctgcttaaaatcctgagaagtggaagacatat<br>gaaaggacaagatcgatatgatcgaagactgccatgctgttgtcatatcgaatattgcacatcctatgagttcatcaacaacaagcagg<br>tcttatcctaaccattgcacatcttcaaatgctcagaagtccgagtcttgtatttcagctatatcactcactatgcctcatcactgaatactcttgaactcatttc<br>aaataagaagttcactcattgtctagcagcatgtatatctgcagtatgatattgcatgtcaattatcatgagagttacacactgctccaactctggaagctttcaga<br>gtaaggagatgaatgctccagaactgctcagcagtatgctgcaataggcatgcaatagcatgcaatgtcaattgctcttcttattctcacattcc<br>taagatacatcctcagaaactgctcagcagtatgctgcaataggcatgcaatagtcattgctcttcttattctcacattcc |
| Contig40_gene_116_1 | 1179 | atgctcttgtagagatttaaagatctgtctgtttttgaaatctggttcgtaagctattgaaaaataccagagactgttct<br>atttttagtcttcacctgcttttttagctccatatattcattacaaatgatgtttcattgatttatattgtaccatttacaattggcttaagaa<br>agttgatagacttgatttgataatgttctcatgtctatgtctacagtctcatcctgcagtctaatgttgctatgtcttcctatcgtcagtgttttgattat<br>aatattgtatgtctaatgtttctcatattccatcagtcattttcttgattcttttgcttatatcgttgatctgcagtgtttttgattat<br>tctatcctctttgttccaagcagtgatgcagtaaactgcctaaatttgccaaagttgagattaataaggaaggcttcttttaaaagagtcttattg<br>gtgttgattattcctctttcttgacttttgggcgtagtttggggtattgggaatcaatattgggatcaatattgagggcttgaaactcttaaagcttcaaatgttcctgtcaatcttgctctcagtgattcacgcactaa<br>tgataatagggcataggcgataattgttgaatcaatattgggatcaatattgggacttgcttgaactcttattgcgtcatgcgaaactctattccatatatgatgaagaattctgtgagg<br>ttatgaggcgataattgttgaatcaatattgggatcaatattgggacttgcttgaactcttattgcgtcatgcgaaactctattccatatatgatgaagaattctgtgagg<br>agcatgggagttcttaaaatcagatatttgattatttacattttacattttaaatgtggttctgctctcttatcctattggagtttatgttttattcat<br>taa |
| Contig40_gene_116_2 | 1180 | atgtggttaatcattttggaatatagagaactttgatttttatcttccaaggagttgtacaggagttgatccttaagatttttaggtgattaag<br>tattcttgtagttatattaggttttcaagctgttatgaggctgttagggaacataagggtggataa<br>caatattctttttagttttcaagctgttatgaggctgttagggaacataagggtggataa |
| Contig40_gene_116_5 | 1181 | atgattggaaaccttatgctccattgctcattgctcttgctttattttgaaaacattgaaaacttattctatcatcgaagttgaatagcagtgt<br>taattcattttgttttgctctatattgagtttgttgttgcctgttgttgtcttgcttgttgatagccgttgttgcttgcttagaacataagtacaaactatgcaatcaagtatgctg<br>attatatgaaattgaaattatgcggaatcgctattattcttatcgagtttagaatccatcaagattgtttcactgttttaatatcattagggcctcaatatcaatcaaggcaaatcctggg<br>aacatccaatccatctgcctccatatgtccatatgtttcaagccttatcttgaatatgagcgttgaacagtcgtgtttgatatttatgtatattcatac<br>ttgttcagatataatcctcttaggggagactttgaaagaggacatagcagacattagccagtttgccgtcctatgctaagttgtgttgttgttgtcagttgtcaattgcattgcattggcattttgct<br>atgacgcttgtaactttttaaatcctacaaactacattagccagtttgccgtcctatgctaagttgtgttgttgttgtcagttgtcaattgcattgcattggcattttgct |

FIG. 9B-220

| | | |
|---|---|---|
| Contig40_gene_118_3 | 1182 | ttgaggttcaaacagagagtggtctttctcctccgatggaatcattgtggctatttcaaggttctaaataaggagttcctaaggtaaaccttttctttgatacatcattagtgcttacagcagctattctttcctagtgttttcctaggctaccttgcaggagtccgtgaaggaaccataattcagctgtaataattgggcctatcgttaaggtgcttcagaagttcttaatcctatatcgaggctgtaatttgaaaaataa |
| Contig40_gene_118_8 | 1183 | atgtctaattcgcaaaatgatggttttagaagatgttttccaaggaaacaatgaactctgctgtgaaaatacagattcaacttctaataaaaaactagattactaaatctaaatctatttcagagagtttttaaggaattcagatctcaggaaaaccaatgaatctcatcttagatctgaagatctgcttctgaattagaatctgaagataaatattctaatagaaaattatctttccgaggcagaatctactagaagtatttagatgctcttctgaggcagaatcttagtgctagtgctagtctgatgataaggatctgaagcttcaataacagaatctatgaaaatctatcgaatctctgatgaagaagaaatttcagaatctctgaattgataattatgttgaaagcattgttaatgaaaagatgactaaagctctgagttctgaagctgaataaacttagatgtctgtcgttggagatgaagctctatgagcgttaaagatctcgaaagaagagctcttcatttgaagctgaataacgcttcatttgaagctgaagataacgctgaagattacgaagatgactctattgacagtgaggatatcgatcaattcttatgaagaagaagctaataatgcttcttcagaggatgtttttatcaaagaaaaataaagatatttaagattcctcctaatattaattatcatatgggtataatttcgtttcgtcaacctcaagttatttacatatgtttacatatgtttattactacacagttctatctgttgaactgcaggtctttgcagtcttttaattatcattggtctttttaattatcggtttcaagttattttcaatttcattttttatagggtaatttcaattatggggtaattcttttataagggtaatttcaatattttataggg |
| Contig40_gene_119 | 1184 | atggagataatgcctattattttcattttttataggtaatttcaatattttataggggtccttcatattaggcgtatttagcacatcatttaggcgtatttatcacaatcattatcctgacgattcttttacaactatctttttagttttatgtaaggtgcccatttcttttgctcattatgggatattgatgttttttgactataatctatcttttgatcggttaagtctcgtagtggtgaggaataacagaatagtgctaaggatatgcatagacttgcactctatatattcttacatcagtgctgttgggcagattgctataccggatatctcatttaaactatgctgtatcaagcagtcctttataagtcagaagctagaaagcttattataaattcctaagatattgctgttttaattatttgcttgtatttgtgccattccaaaaatagatctcagaagctgatttataaactctaaagtgtttttataa |
| Contig40_gene_120_2 | 1185 | ttggaacgtatcatcggagttgtgatgaaactgccaaaacgccagcatatgaattagaggatgggtcgattatgtccctatgaataatacaggcattattggttcatttcttaatattgcagttttagttcctaatttcggagctattcaaggcgcattattcgacacttctgcattcttatggatcgttttagtactactcttgtgtgagcgaatgaaggcaatgtcgttcgaaatgacggtctcaaatgcctgaatataagcaaatatttggagataggttcgcaagttcttgcgttttaaatattataacatgcattcttgttgatgctgctgcagatttgctttcaagtttaacaaatatagatttcggacttgttttatcatggctgttttatacgctgtattcctattctgcatcagcacattattttcctagcccattgatattaaatccaaattattcattgccaatttacaactgcgccaattgttgcaagatgcgttaaaaatgacgcctcaattagcacgtatttatgatgatcagtattagctgcaatggttattgaaggaatacttgcattaatttgggcaactgccattgccatttttcccatgacagccatgctcattagcacgtattcatggcaatcattttatgatccagtgtaatatgtccaatcacctcaggggacacttccttcgtagatgtcaatagcattgattgttgtactgtaggattggtttgtaatatgtccaatcacctcaggggacacttccttcgtag |

FIG. 9B-221

| | | |
|---|---|---|
| Contig40_gene_121 0 | 1186 | tgcaagaataacaattgcagatgaattaggtttaaatcaggataaactaaagactagacttaagatatccattc |
| Contig40_gene_121 2 | 1187 | atgttaagttaattaaagacaataaggcttttatctcttatagatgctattttatctcatttttatagttctaatctcatttaa tatgattgtagatatggagatgcctagcttgagcgctacttatccgaagcaacaatcaattcaagacaagtcttatgagctgatgtcttcaaagatag atggcagggattattccacattggagcgaatctcatctgagctctgactatagttttatcctccaatgataattcgatagcctcaagaaggaagttaagaatattcta gatgattccttagcgctcatctggagttttctctagctataagaaactatgaaattattcttataagcttttatattttcaaggcttaa
atgaagaacgtactggactttttcaaatggagttatctggttcggagttgcaatctctgtctcagaaatagaggcaggaatacagcttgcttc catgaacacccttgattccatttggctaccttagtcctggccacatcatatggaggcatactgctctattttctacaggacttataggtgcacgtc ttagattgaatgcaatggagaccatcaacaatcaaccttgcaattatgctccaaattcttttccacattaaatgtattgcagcttatagcttgg gtagctgtgctgaatgcacaagggcttcagcattgatgggcttgaattacccatatcctccctttaacctgcattatcctgtctgcaatcat tcagtatggtttatgtaggacttagaagtcatctaagattactaccattatgatagtgcttacagcattgctgtgttattctatctgtaa aactcttaggggtccatatatccatgcttcctgtgattcagatttatatacccaaagatgtgaaaaccagtaaacgcattggtctctgcaatagct atgccaatctcatgcttcctgtgattcagatttacaaacattaattcaacagcattaagcttttggagcatctttgaaatttcaatagct agcaagccttggtgattatttagtgcttcaactggcatagaaaataccaagagtgtgaaaaaccagtaaacgcaccagcatcctcctgcagtcttgagctc aaggagtgataaattttagtgcttcaactggcatagaaaataccaagagtgcaggggaatcagcagggaatccaaagccatcttttaatagaatc aatccaaagattgcaggagttgtagtagttgcaggttgcaatactgcaataactgcaatatgataaccttaatattgattcttatattctat tgcatctgtatttgctcctatgctgcagtgctctcctgtatctttctatctttcaagagaagagactgaaatg
atgaatgaaacaataacaatacaatcctaacaattcaagacatatcctgttatggacaatgctcatcacagttgcattctgctaattctgctttttgg aatagaaaacagcaatcctccctttgctactctcaacacacttcaggttttactgatttagagatcttactgttagagaatacataaagac aaatccgtaaacattggaaaaagaaaagaaaaatggccttgtttttcgattcattgacctgccatgcagagaattctataatgatttgaccaagaatt atcatagactcaagattaaaagaaatgggagagcttttgtaaattgaatgtcataaggaaaactgaaagatgcttttatcctacataagccttggaaagaa tgcagataaaatgaaaagaaaatgctacagatgtgcctaaagaatgcggctaaagacactattcactaaaagataggataagaagaagacaag atgggaatgatcgttttagataaaaatgaactattatgagtgcccttcagcagcagcagcaattcagagttgtatgatctgttaaaatcaataa ccattggcgatgagactcatactttatggagttaaattcgaacaggcaattcagagttgtatgatctgttaaaatcaataa
atgatggactggtccctattttatctccaatgaaaccgcaagcctatcaatctttataacctttcttaggtttgattgtagcttggcttct cgttaagataaaaaatgacactacaaaattgtactggcttcttttagacttcttagagtgcattcaatgcttgaaagatagcatttcatgcctgcaactgttatagct tttatattttggtatcagaggacctataggaagctcttctgctagagtgcattccaattattgatgccggccgtacattagg gcagtggttatgtcttttcctttatgtatcgttctgctagagtgcaaatgcttgctgaaatcttattggcgaattcttgctcttatgccgtgcttagg tatgtctgagtggaaggcttgcagacgttgcataagtgccgaaacactccctggcggttactttactctgaagtgctgctgaaat gagaattcggtaccgcttgctcatcattcatgcatacacaagcatggtgctttactgactattttccatacgcaaggaaaaccaa atgaaaactag
atgctcaaaaagaattggatattcctgtagatggcatgcattgttcctcttgttccctctagtgaaaagtcgctaggtaagcttgatgaagt
ggaatccatcaatgtggacctaaacaccaataaggcccatatggtgttaaaggataatctctcccagaaacaatcgataagacagttgaatctg |
| Contig40_gene_122 | 1190 | |

FIG. 9B-222

| | | |
|---|---|---|
| 1 | | tgggatttaccgttccaaggaggaagtggtcattcagattgctgctggaatgcattgtgcctcttgcgtgaacaatgttgaaagttccttcctcgt<br>gtagatggtgtggttgaggcaaatgccaatcttccaatatatcggccttgacggcgaacttaccatcacatactagggacatgctcaatctaaaggagattcaaa<br>gacaatcgaaatgcttggattcgaatatatcggccttgacggcgaactggacataatggatgaagaggaaagtatcaaaggacctagaggca<br>aactatatagaatcatagtaggtctgtcttgccggtatacttagtgcattccatattccattacaattcctcattgactatggacaa<br>ctctcttaatcatagctatttttccattctgttagtggcatttatgtaaggcatgcctatcttaaaggctggactccttcaagcataagaacctagatat<br>ggatgtaattgtattcaatgggtattcttgtggcattgtatcaagcgtattagtacattcaataattctgactcaagtttatgttctatg<br>aatctgcagtgatgttgccttcattcctcactataggacgttatcttgagcaagagcaataagaaaaacctcatcatcaatcaaggagcttatt<br>ggccttcagccaaaaacagcaacattaattacaagtgatgaagaggcaatagaaaggaataagatagatattgaggatatcaatattgaga<br>catattgcttgtaaagctgtgaagagatacctcgagactctattgtagttgacgtgaaagctatgttgatg |
| Contig40_<br>gene_122<br>2 | 1191 | atgatccgcataggggcaatactgctattcctctgcactattctatagaagattcaattagttatgagtaattcgcctttaat<br>ttcaatcatattaggagttattttttctcaaggattcagagaatatgacaaacttaaattcaagacggatgatcatcaagcatatcatggc<br>tatggcagttcttgttggagcaataatcatgatgctgattttagatgtctcattcgtagacgcttttttgaaatatctcgtgaccgga<br>agcggattgaccatgttcagcgatgttgaatccttgccatgtcaatactatttttaagaagtgtgaacaatgatcggtgactgtggtgt<br>aatcatcttcataagctactcattaagcctgaacttctgactctctgaagctatacaagctcaagctcttatatctttatagcaggaataagcaaatataa<br>aaaatacccctaaaaaaacaatgcagatatatcgcgcgagaatgtcaataaagaatgcaaatgtcaacaaatgatcttctaccaaaatgatatgttataataatcac<br>tatcttctaatctgatattaggggctacaagcttttacagtcaataagcaattcataaaatgctaaacaaactgtctcctgatgtggtttccatgtgtttctgca<br>aactattgattgtaagcatcatactttgccctccaagtgagcagcatggtaattaactactctaaaagcacatcttg<br>tggttcttcagttccactgtaggtctatatatttctcataagcttgtagtagttgtcatatagtcgattgat |
| Contig40_<br>gene_123<br>1 | 1192 | atgggctcattgtaatcacattcatgatttgtttctccagtaatgccaaatttcagactctctagaactcttcatcctgacgttcttc<br>atattttgaataggatcttgcctaatagcagcatccataagcatagaattatattttagcagactcatacaaggattcggctgtggaggaata<br>ttcccagtagcgggcattgtaggagcagcattaatccctatgctgaaccagatataagcattcctggaagcgtatttgaatatcagc<br>aataggaggctcttgtaggacagcagcattagatatgagaactaaagatagactattaggaatactattctatattgctcatattcta<br>ttgcatggtacatactgccagactcagatagactcaagcaattttatagcgagcctactctctgccaatccatatgctaaagataggagaataatcattcatcataatttctaat<br>tcctacggcttaatcaaatagaagtagcaaaaaagccgaagtcatcgtgccaatccactggtaatcctaagataagcaagaaaataacatcatgcatagaaa<br>cctatgctatgaataattctactcttcagcaattcatcaccacctgtaatcctttcaatggattggacgaccagcttgcaagccttatg<br>ctgattccaatacttgagcaaatgcagttgcagaccgattctgcagcaccgattctgagaaaatctgataaaacaggctcaaagaagcttatgcaatgggaac<br>aatgattcttgcaataggggcttattgcaattgcaatctcatcctaatatcttcatagcggat |
| Contig40_<br>gene_123<br>2 | 1193 | atgcaaatgaaaatgtagagctaatgagagagcaccggagatagcagttaagaaactgcaatccaatcatgattccatgtcctaaccgc<br>atcatatacataatcgatggaatatcgtagccaggcttagcccaggcagcaattgccggataggctttgtaacccatattcatgatactaa<br>acggtgtaaggctaggttcttgaagcggtgcaacaagcagcataagtcgtttgtagggctaaaaaccacgaaggagcaaacaagtcagcaacc<br>catgcctattgtatttccttatagcctcaataaatcatcaatatcctccaagacctctcctagaacatatggacaaggg<br>acaatctctagctgaaggactaaaatacggaagccccctatttctaggactcttcacattcatgtttgcaaattgaggagaagcggaattctccgtg |

| | | |
|---|---|---|
| Contig40_gene_124<br>9 | 1197 | atgaatatggatttcagcgtaaggatttaatgtacgctccgacaatacgtatttggaagtagtcatagctcttgttgtagcattctttt<br>aaccgatttacactgcgatttatttgaatctgactactctgagagcagagtatatcatattctcttgtatatgcattgtcttcttgcaatagcct<br>ccatcggacacatggttaaagatgacatatacggtgtattcaaggcctccaatctgtttaagtcattatgatagtcattatgcatcaccaaatgctc<br>ttgctttcttatacagcagcatctgtcttcctttgaattctttaatcaattattagctcttccagttcttcttgcattttgcttatga<br>ggcttcaaatctctcctgttcctttttgaattcttttcagcaatctcattcttggtgtattctctctatttggattatgccattcaatctatcagaccattggct<br>ataggctaagataagaaaagagtatatattggagtgtgttgcattcgatcatcctttcatcatcttgagattatgccattcaatatatcagaccattggct<br>catatatcttacactgcctatttgataagtatacactccataggggatctctcttaggagtccgtttatgatttcactgtcatagtcttgtttt<br>taatctattgtcttatgtgatagtatacactccataggggatctctcttaggagtccgtttatgatttcactgtcatagtcttgtgttt<br>caatagtattgttccggcgtatatattttattctctataaagctgaaatga |
| Contig40_gene_125<br>0 | 1198 | atggatttaatgtaacagacttcaatgttagattaagaacaattaagcttaggaattattagtaggtattgtcattgctttattttatccat<br>agccctctaatcatatttccagttatgatgatagtgttatgatgatttggctttgatggtttttgtattcttcttcttatgctt<br>taaaagtacctctgtctaaaacaggatttcaatacaactatttgaaaggacaacagtcgtgaaatctctttatgtctcattatcaatatgttg<br>tttgctttttagtcctggctatatttctatttgaatcttcacttcacttcagtgttcacttccatttcaatatgtggttctatcctgatttttactcctac<br>tgctattgatcctgcagtttttctatttgaatcttcacttcacttcagtgtttcactgtctcactctcactcacactcac |
| Contig40_gene_125<br>2 | 1199 | atgttcttganttacggctattcctacaggttacaaagtctctgtagaaggatgattaacgtaacgatccattgccagaatttgatgatgt<br>gattggcatgttttgttgacggcataaaggttgctgaatctgtattggcttgcctattgatgatcgtattgatcttgctctattactcttctagccataatcggcgctcttagtgtgatgagcatg<br>ccagcgctattggaggatatgcgaatctgtattgcgaatccgacgggcattgcaaaggcattgcacattggcttattgacattaaggagcattattggacatcaatcactcttttgactgtctcttcttgtattcggattcttg<br>tttggagttgcaaacatgctatatatttgattgctatactgcagcaggagcatatcgagcatattcagctattcagccatattccaagagcatcagagttaggtatctgcagcaggagcatatcgagcaattctcattgaggaatatctcatgagaatcactcagcaggagcatatcgagcaatatccaagagcatctatactcaagagttgctgattatgcaatcaagagttgctgattatgcaatcaagagttgctgattatgcaatcaagagttgctgattatgcaatcaagagttgctgattatgcaatcaagagttgctgattatgcaatcaagagttgctgatta |
| Contig40_gene_125<br>3 | 1200 | atggctagcattacagacattataaaggaaggactaaatatccattcaatgacactagaaagtattgatcttggctaatattcctcatctc<br>tgggctcattccctttcacacagtgtggttttatgattccatgaccctatgtcaatgcctcccatacctcagtaatgaatgtttg<br>catcaattcctccatcatagatgaagatctcttaattgcagcttaattttcctgtcatgattgtaacattcatttgtttcttcacttcaggatacatatgatgtt<br>atttaaatatgcaatagatgaagatctcttaattgcagcttaattttcctgtcatgattgtaacattcatttgtttcttcacttcaggatacatatgatgtt<br>tgtttattccattgtgcagctcttatatcttgttgcaatataattcaaatatggctgggaagattactcggagcctttatcagagcctgaatgcatatcttcactctcttgttagttctactgagatcttaaagcttcgagaaggcttatcggagcctgaatgcatattgtggagagatggcatgcatgttcagcagcttgaaaatgacagtctaagtct<br>gcattccaattagtgagatctttgataattcaaatatggctggaagattactcggagcctgaatgcatattgttcgattctgcattggttcaactcttgttagttcta<br>tattgactggtttgttatttaagtccatatacgtattgcttggacagaatgttggatctgttttagaggctattagtgagtaa |
| Contig40_gene_125 | 1201 | ttggacatgatttcaatccttaaattttaattgctttgatttttgagatgattttagaagtttttagaagtgtttagataagtttagaaattta<br>ttataggtag |

FIG. 9B-225

| | | |
|---|---|---|
| 6 | Contig40_gene_1257 | 1202 | atgcttctattttttatttaattctatctctaaaaagaattctagttcaaatttcaagttgaataggattctaa<br>ttcagtaaataactctctcttgtatctgcatgtgcttttagaaacgattaaacagcatattcaagtttcaagatttctaagattatatttgttt<br>tagcaaacatactatttgtatctgcaatatactttgtattaagttattggatccatatccattatcagtttaatgcccttattcgtgat<br>ttcactggttaggcttagtttgatgtaacgctccttaccttataactgtagttactctccaataatcgaagagtttctcttagaggaatctt<br>cttacgaagattcaatcttgagcttgacacttgctatcttgattctccagtctattggaatttgtcataacttggaggaatat<br>tgggagctattctcttgcgcttccatcttctttatgtcaagtccaggaatgtattagtccctatttggctcattcattaacaatctc<br>attcttttgctgccttattgaatagaagaatttcattcatgaatagcattgtcattgcttaataatcattttgccattataagtaa<br>ttttgctctttagagctattgttagagtgcctaaatctttaaagaatag |
| | Contig40_gene_1258 | 1203 | atgtaaaattactggaaaagaaataagagattaataatatcattgtaattgcttgcattctctattcttattcaaatcgtgattt<br>taatgaattctattcatatttccaatagtagtgcaatagagtaggtgccgattcatctttcatgaatttaggcataagtttgcagctatgcact<br>atggatattgggcagaatatcaattatggccaactgacttgtcattgcattggtaagttcctttcgattcatcttcagctccaggagca<br>gttgcataacagtcaggaatgtcgagaaagtgcactgcttgcactttgttcactgcagtcctgcagtcaatatagtcctgatttgatcttttt<br>agtatttaaattcattaggctcagtcaggtcactgcttatatatatgctataataagtcaggacttgcttgcatttcttgatattatttcttctggtcatc<br>caacattaacttattgcctatcccaccattgatgatctaaagtttatctgaatgctttttgatagttgcattgcatatctgtt<br>atattgcttgttgtctatgtgcggttacttgatag |
| | Contig40_gene_1259 | 1204 | atggcaaagaagatgataaatacagtatgcctatgagtgggcaggtttagtaagatactttgatgacgaagtgtagtccaaagatagctcc<br>agaatacgttattgctttaacagttgcttattctcgtatctttttgttcattttaagatactccatataa |
| | Contig40_gene_1267 | 1205 | ttgatgcattaaggcattagcaattatctcgtaattgccatacatgcttaattgccaataacatttagaataggagtagattcatcaaggaattttgttattagcgaattggtgggaaa<br>cttaccttcattgaattgaagatgaaggacttcttgctcagtttttgctcatagattcctagaataataatccattcttgttttatttggagcatctcttagaaccata<br>tagtaggatgggatatctccttatgcataagtctcatttggaaacaatgtttcctagtattcatggcactcatagttagattttggcagcttccattcatgcatttgtgtatctagtatttatgagaat<br>ttttctctattgctattgttcatttatgtgatgttcattatctgataagttagtgcttaggatttatcgactatacattaggagtgaattgcaatatgatgtcatacttt<br>tggaatgatcttctttcattcttattctctcttctctgcattaaccaatatttgaatctccaatcagattgtcatacttt<br>acaagtcgataggtttggtgttttagcattgatgtctgatttgtccttggcctattcatttctaggtaatcatagaactccattcaagattcatgctgatcacttcag<br>tttctcaagcctattgatgcttcctttaagaattcctataattctgttcttgatgcatattctgatttcatattatgtcaggcctggatctttaataatca<br>aggttagaggtgttcttattgttcaaccaggtaaatgcatatttctgatcattatgcatttatgtgttggtgcactactggcactctggcaatacaggcattcc<br>gctttatgcttgccaggtatagttatatatgattatatgttgttgttcttcttactctgtttcgtgattgtaatgcctgtattaagta |
| | Contig40_gene_1271 | 1206 | atgagtgaaattcttcctttctgtggataatctggttatttatctgctgctaatagcattgccaatctttttgttcttttgtatcatttatgtt<br>agtagatatcctgtggcacctagatgtatagacaggcgctttgtgtgtctctagtcctataattttccatcttgctgtgtcctgaattgaattcattcg<br>tctttacaatcagctgcctagagattatatagcggctttgctttgctgctgcattcattcaggaatttaaaaac<br>cctcttgctctccctgatcttttggtctcttattgcagtattcagtattcattcaatatgcttagcgacatatgaatcaaagacatataaggcggagaattttactcctgttcgtct<br>actttctgccttgtcttcttcaatgcattgttcttcttcttcattgcgcatttctcgaggaatttactcctgtctct<br>ctggtactgcagtctgcattcttcaatgcattgattcaggagcaaattatgcagatcctatgataaattgcctagatattacctattgg |

FIG. 9B-226

| | | |
|---|---|---|
| | | cttatgggcagtctctctgcagttaattttgataagctgcaatgatatcattccattgtgctggaataattgtcgtcatgatttaagatg<br>gcatttgaatgtcctctctgctgcagttccatctgtctctctatgtgatcagtgaagcccatccattgggatgattgattgttattattgctgtactt<br>tagtaacatctgctgcagttccaatcttaagcatgatagggcaagttccctattgctcattgctgtgtcctcatatgactcgtataattgtaggtccagaccat<br>aagatacttattccagcttcattattggtgttcttcctttattcctttacttgcttagaaaaggctattctgagtgaatt<br>tggtattttaactgcaatctgagacttgagacttcagacttgaatt |
| Contig40_gene_128_4 | 1207 | atgagcatgtcttgcagacttcgagcctgcaaggctgcaaggacatgggctgaaaggcatgatgtcgaaatcctttgctgtcatatgccttgc<br>cataagcattgcaatgctactctcttttcttctgcgtgcagagccgactgttgcaggagtgatttag |
| Contig40_gene_129_9 | 1208 | gtggctatcctattgccattgatgagcatgttaggaatcggagaattgactcagaactacatattgcaatagtgagcgtatgatagccttgt<br>ggtttgtactacaacgagaagcacaacagcgattggtgagcgaaccaccaagtgcgactgcgagcttgtctatgggggagacgatgaagcac<br>ttatatga |
| Contig40_gene_130_0 | 1209 | atgataaccactggcgtagtgatattgttcaacagcataaccgagcaccctttacttcatggagtgggacgagataggaatcgttcttggaatcgt<br>ttccatcaccatcgcctcatttacatagcgatgatagacagatgataggaaggaacgcaggaaggaggagcttgacacgatagaggactacataa<br>acaggaaggctgaggagatagcgaacatgaaggtattgaggaaactgaggaattgaagaggaatga |
| Contig40_gene_130_4 | 1210 | ttgggattttgggattgacaacctggcgttgcgaacctctcctgttccgttaggatacccttcatggagtggcagacgtgattacagagagtctatggagag<br>gacagctcgaagggtcatatgcttggctctggtctcttttgcgatttgtgctaccacattgactgtctcatacatgcctatccaagctatt<br>ggacagacagggagcgtatgcctacatgtcctacatcaagaatgaccaacagcaagtacccttcatcgtgcttgcaggttcatagacaatcgatctacttggtgaccagttcgtgaat<br>gcgagacttatgtgctcatcagcatgtgctcttattacgtattgcttatgtgccataatgttcatcatctgaggacatcggatctacactttctatgggagggagcttgtgatag<br>ttgcatatgcagcagcattgcttattacgtattgtgcctaactctgcatattgcatattcttattcttatgcagtatgttgttaaggttacttggg<br>aagtggtgatgcagcgcctctgacatacaagtcaatgctgctctgggctcagaaaagacggatag |
| Contig40_gene_131_5 | 1211 | ttgaaggctattggagataactctcagtgattatctccttttagcattattctctagtggagatttgatattggttgccatcgtctcaattc<br>ttatgtgtcatctcacctgagaatgtgtcttagacaattttgaaggaactggtgattgactatataagttacaggaaaagtgatattttgagacatctaaggagac<br>ctagaatgagttttgaagattatgtcttagacaattttgaaggagctgaactcaccagagagcaggttgttgattcgtcttgaattggtctctcga<br>caagagagaaggactcacctctgcaatgagatcttcattgtgtgcctttgaagaaggggagcaaggacgatatcgttgagatattgtggaa<br>tgagtattttgtgaaggactatagaagagagagaagaacaacgatctttgttgaatgactgtgaagaactttgaagaagagatag<br>ttgagaatggtggcgatgacttccaaatcttttaggaatcacctgattgactgtgtcttaatgagtattga |
| Contig40_gene_132_7 | 1212 | atggagaaagtagaacaattaacaatagaaaaaaattgaaagagaaactgaacaattgaaagagctattaaagaagcaaggaaca<br>atttgaaagagaaagaactgaacaattgaaagagaaagagaactagaaagagagaaaagagaaataaagaagagataaaaag<br>aaagagaaagaaagaaataggaaagaaagagaaagatagaaagataggaaaatagaagaaagagaataaaagaattgaaagagag<br>aatgaaaagaaagaaataggattaaagtgataagaagagagaagagaagagtgaagaaaacgtgatgactattgatgaatattacaggtcaataggatacggtcaa<br>aagaaaataggatattaaagaagtaggttgtcagcaattattattcaataattattaaggtttatattgattttataatgttttatgggagggaatgtga<br>caggaaaaagtaaggtatgtcagcaattattattccaataatattaaggtttatattgattttataatgttttatgggagggaatgtga |
| Contig40_gene_133_9 | 1213 | atgctgaagacaaacttcggaatcaccaaggacacccttactgacccttggatggagtggtgccgctgacgtgtcaaggctatcaggaggcatt<br>ggacaaggctcttgaagaggtggagacatggagacatgctcgacaccacaagacacctttgagacattgaagaaagaacttccgttgttcag<br>gaaggcatgtgggagagatgttcactcactacatagacatgcagtccagaaactgaatggctttgaaggagacatgtcctggcttgtttgagaac<br>cttgtcatgatagcgggtcagtgcagtgagcggattttgccactgtgagcctctccatgatgtctctcctatgataagcgtcttgagatgtgggaagtgcgat |

FIG. 9B-227

| | | |
|---|---|---|
| | | aaagaggacaggattcttggactgatgaggttgcagagacgcagtaaccttgaagtcaacattcctgacaatagctcagattgcaggcg<br>ctgacgcagctgtgcttcagactgccgcaaacagcggtttgactgcaagcttctgactgagttgctgctgcaatcttgctaaccctttgacttgg<br>gttgcagttgcacttatagccattgcagtagcagtctcatgagtcggaaagagtttcgatggtctgatatagctccatgattgtgctgt<br>ttggcaggaatgcaaaggcttttggagcgcctcataaacaatcctaacgtgcaaggattcctgaaggacctgtctaacgcatggaatgacatat<br>gcgaggcattggcaccagtcgattgggagacttctaggcaaggctggcaagttgtgaatgccgtaaatctgcttgaaacgcattggaacattgtcaggcg<br>ataattgacgttttcgacagttggaccgtaggaatgttgtcatggcttcatggctgtctagagaatgattgtctgcatacttttaggtt<br>ccttcctatgctgtgggacctgtaggaatgttgtcatggcttcatggctgtctagagaatgattgtctgcatacttttaggtt |
| Contig40_<br>gene_135<br>2 | 1214 | atggatttaatttttgaatatctgattgtttttattttattttgccacaaatatagcattttactaagatatctagttttaataaaataa<br>attattccattgtttgtttgtttgtctatgctatgctatagtatttgcattaactttgtatttctctcctgaattacaaaggaatccatagattta<br>ttccgtatatttattttattttgctgttagtgcttaattactctattggggcattggcttaagtttgggattttaaaatcagataatcttttctatctggtcttga<br>gttgttttatatgcactatttttatcttcattcttttcttgttgtatttatcttttagtttatatagcttttaaaaatctcaacaatgctaaaagaccatatatgcagtcattggtg<br>attagctattctttctgttgtagttattttgcttctatcttttagtttatcttttagtttacttttaagcttaaccttctctagcgtaagaattgattattcaatgtttgatctttcta<br>aatatatgtttttagaatttattttgctctatcttttagtttatcttttagcttttacccttctctagcgtaagaattgattattcaatgtttgatctttcta<br>attcttactctacatataagtgctatatatgattatgcatatagcaattgtcattttgcttgtttaggggtttttatataatgattggttttaaaaag<br>gctaaaaaggaagtaa |
| Contig40_<br>gene_135<br>3 | 1215 | atgatacttcaagtacggaaatattgacttcgtttatccatattgtttctgaaagcttgctgcacctgttgtaattgtttagtatattctt<br>aatctatgacaattttaagcttgcggattttaaatgaatgtttacaaaaaaagccattgaaatctgcaggattgaaaagttattgcaagaca<br>tttcagctccgatagtccgagagctgaaagctttaaaggctgttataagcagcgcttgtataaagagcaaaagaaatctgtaaagataactgat<br>aattataatttaggtccagaggcaagaaagcttttgtctctcttgtcttgtacttaataccattggtcctgacttctgcttaggtactgggatattacca<br>tatttagtaagattaggccctatatttggtctctcttgtcttgtacttaataccattggtcctgacttctgcttaggtactgggatattacca<br>ctctgccaatccttgacaattgcttttgatacaactgctcactgtttgactattggtgactattggtcattaggttatattgtttctaaatatagaaagcaa<br>tggtatgaaagtgattgactacaactgagacaattgcagaggctattttagaaaaattgaatcagttttaa |
| Contig40_<br>gene_135<br>4 | 1216 | atgttaagaaaagaaaacgtttagtgatgatggcgatgaggatccatatgtctggattcaaatctttcagatgcaatgcttgtgcttgctttt<br>agggttttgattttgcattatgctcttcaggtaaaatcctgatatgatggctaagactcaggagtctcaagcacacaggccacttctcaag<br>tgagcacaggtcaggacttcaggactttaatagtagcaatgccaatgcagttgcctcttagagcagtctggttatctgaggtgggaaaagtttataaagatcct<br>gatactggtaaattagtcatggttcagggttga |
| Contig40_<br>gene_135<br>6 | 1217 | atgagtttaaaagtcctgcagatactgcaaaagcagttgcatctgcagctacccgcaaagtgaaatgcctatcataaaactgctatttagg<br>tttcttagcaggtgcatacattgcattcggagggttacttcgagaagtagcaaatactggtctattgcggttgctgtggtgagttccagtaggtattctta<br>aattattcgggacagtgttccctgtaggttaattatgttcactttatctgatctgaattgttgtcactggtgacgtaatgttttatgcatatg<br>ggtctttagacgttaaaactgattcatgggtaggtagttgggtattcaacttaatcggtggtctcttcgttgctta<br>cgtacttgcttacttaactgtgtaaatcaactgctcttcttaactggtacctgaagcattcgctgcggtgcaattaccattgctaacactaaagcattagttgagctacct<br>tcatgcagctggtcttgcgacgatgtagtagaatcttcgaattggttcccaatcagtttctcagagtatcggttgtaactggttattgagcacagtgcgc<br>ttagctaacgctgctgacgatgtagtagaatcttcgaattggttcccaatcagtttctcagagtatcggttgtaactggttattgagcacagtgcgc<br>aacatgttctcatccatccattagtatcttcttaggtgctgaagtaaccattctcatcaacaacttaattcctgtaacctaggta<br>acatcgttggtgctgctgtattcgtagcatgtgctactgcttgttctgtatactttacgcgactaa |
| Contig40_ | 1218 | atgctttaaacatagctcagttcagtcgttgatcgaagtttgtatcaactttatcgacacaggcggcttacaggtcttacagtctttagagcttt |

FIG. 9B-228

| | | |
|---|---|---|
| gene_137_8 | | ggtattgttaattacaatattgaatgctgtttgactggagtcaaatttagctttgaataaaagcggaatttgatgaagtgaagca<br>atcattatttcacaactgcaatgctgcaacagttctatcagttctacaatgttgatttttattgcttttattaaagattcctaattaactcta<br>ttgcatccgactgctgagcactgcttagtcgagcactgccttatgtaaacgcattgtccatttcatcagttccaattgcaactctttggagtattatg<br>tcaatttattcgtgttgacgggcaaccgattttgcttcaggagtaattattgttgcagttgattgtcagttgattgtacttttaagtatcattttgattca<br>gtgtttttcatatggcattgaagggcattgaaggggcatcactgcgatgatagcgttatgcagcgctcaacaattgaaataatcaagataggtcttcaggccaag<br>aaaagaacttcgattcgttttccgattcgtttgattctatatcatggaattttaattgtgtcgccgaacattatcttcctattattatgcccaaatgattctat<br>catggcttcttttaatgtattgttgattctatatcatggaattttaattgtgtcgccgaacattatcttcctattattatgcccaaatgattctat<br>tggttgcattgcttttaataagcattttaatcatggaattttaattgtgtcgccgaacattatcttcctattattatgcccaaatgattctat<br>aatcttcatcatattgtgcgaaattcaattaataacattggtctgttcgtgatattcactgcattcctcttaatatatcctgatggtctatt<br>gatgtttttcaaacttcaccaaacgctaatgatgattagtgttgaaatgcgattaggaatactcattggcat |
| Contig45_gene_1 | 1219 | atgaatattataaaaatctgcctttgcaataaccggattgatattggccattcttcttcacttgaaagatattcgctgatttcagcgccatat<br>cttcataatcggctctattttaatattatggtatgtcaaagcttgttttcatttcaatgactttttcctgccattgtcacaagatattgcctttgtg<br>taagcacattcggtacattctcaatggctcttatgctgtttggagcacatatctaaagcccttattcctgccattgtcacaagatattgcctttgtg<br>atatgggttttaggaataataatctcacctatccattatttttgctctccaaaacaactatgtgctctaccaattcaatattgagatgtctatgc<br>aacttggtggatcgtctatattggaattaccatggctgcaattacagctccagccatggcctctcaaaatatgattcattttcttgaatag<br>gattatatattgatgatcaaacattggttctgttcgtcctacagatacattaatttttaaacaaataacgatcaaaataagcattcatttgcatt<br>tatgctgcaattttatcaatcctttattgtaggatacgtgaatgctatgacaataaaacgcactttctaagcattatctacataggcagttat<br>ttttatatttttgcaatattcaagcattcaagttctataattgaacttttgaatttatgccaagctttcagccttacattttccattgcagttat<br>taataagcgcaatagctacaggggaggcctataagttctttgacttgatatttgaatttatcttcttttatattcaagcgttatagctttgatt<br>tagtaatattggtattgtataattattgaagttttttaatgaactag |
| Contig45_gene_10 | 1220 | atgaatgaacagacaaagctttctaaggatcattatatgattttgctttaagttgggccggttggtcttgatttctatgacctgtcctatt<br>tacttttgattcacagcttcaatccagcttacatactccagtcgcgaaatgcttgcattagatgttccctatttgctacagacggaattag<br>gggaatcattttgggagcattaggtcattaggtgatagtatgtcgtaagaaggtattggaatgacaattcctgtctattcgatgaggacactgctatgt<br>gcattctcatgtcattctattctctgttctattcagatcactgcgattgaggagagagacggaggaggccaaatctataaag<br>cgagacattcctgataatctaaggccaagtttcatgagctttcatgcaatccatcacccatattcattgaagatatcttaaggaatcc<br>tgataagcctattattggctgagaatgacattttgtaaccaagaacatattcaaggttccatcaaccttgtttcaaaggaatacagaagatattccct<br>gatgtctgattaaaataaggatgattttgtaaccaagaacatattcaaggttccatcaaccttgtttcaaaggaatacagaagatattcct<br>tatatccttggtattgtgcatattcggtatgtctgcatatttggtctgcatatcgttttacctattcctggcttccaacctatctggcagaggagggccttgcaa<br>tggttacaaccctcccttgaaactccactcatactgattccatggcgttgacttacagagataacaacaatattggttttgtagctgaaagataggaaggcgt<br>cctgcattcactactgtcactacagtttcatcatggaacaggattcgttcttgagctgaaatcagataacaacaatatgctgaatcagataggaaggcgt<br>ggtattcatgttcctaccagattcggaacaggattcgttcttgaggatcgttctctattctcagagctattcc |
| Contig45_gene_29 | 1221 | atgctaataatagtgttattaagacgtattgtttctctaattaccaagcataacatacttagtataggaactaagtatttcctactacagagct<br>tgaaacagagtatgtagatatgttcaattactctcaaacaatgcttatgaaatcgataaagcgaatattactactagaaagtatcttcactaatc<br>tagttagagatgttggccgtgaagtgacagtacatgtatgttgagctttcagacctttctatatcatagattacttcacagacattacttaagga<br>agcaagatcatcatgggaagtgacagatacatgtatgttgagctttcagacctttctatatcatagattacttcacagacattacttaagga<br>aatggggagattattgaaagaagcgaaacagagattgtttcaagattgatgtctaaaaacgatgcaataagaataagcaatcaagcttgtaggga |

FIG. 9B-229

| | | |
|---|---|---|
| Contig45_gene_38 | 1222 | ttggattgatataacattcgtgtaaggcagcagcaggaatgactggcgctgcagccattgaaagatcaatcaagttcataaggaagttga<br>gatgttccaggtgtggcattccaccaaattagaggggaatatgccctgttttagacactccattaaattggacactccattgaacatgcagaata<br>tcagcattatctattcattcattgacatagtggattccactaattcatatcaaagcttgtagagcttatgaccagcgtcaagg<br>agtttatgaaaactgtgaagtgcatatgaagctcacgtgaagtgagatgaccttattgctcgttcccaagtaaggagtgcaattcgt<br>gcaggccttgactgtgcatgttcattctaaataatgcgcaaagtaggtattgaagaagcagaagagaggcaggaacgtgcaaa<br>cattgcagaggtgtattaaagattgggcattgactctaatcgtatttgattgcaaacgattgtatgcat |
| Contig45_gene_52 | 1223 | atgagaaagtatttgaaagcatcatagaagcttttaaagttcattcagagattgaaaaatattattgtaattggctttctctattaattgc<br>ttctttaggaaggaaattgccttttccagagaccacagcagacagtgttttataggtgcactcttaatactttttttgcaaacaggatacg<br>gttcaaaaatcgtttatagcggattgaaggagagaatattcctccaaaactaagcccataccaatttagatatggaagtttaaaaaatc<br>attatcatcatcattatgtccattcattatgtctatattcattagtgttgaaaaaccaggtattccaccatggaaagtttattaagcattctatttaa<br>atttgtttaggggaggaacttatctcttgatgttggagtcttggacatgatatccatcgtcatatgccatgatatctcaaacattaacaatttccaca<br>aggaaatcattgcaatcattcaagaagattggattttgcacttcaatagagctgtttttatgtataattgcattcttcttgcaccaatagccctaatgtccaccaa<br>aagattgatctcattaaattaagaagaatcttatcttcagatgaagatttgaaaaatttgcattctaa |
| Contig45_gene_67 | 1224 | atggattatttgctcattactctaaagtgtgataaaatgattgaattatataattgtattgttgttctaacattctgtcacgtagcctt<br>cacttacttgtaagacatatctcacgtgatgcagatgtttcagatagcctattgtcagtgaacatagacaggaactcccaccatgg<br>gaggaatagcttcctcattcttgccattctattctattctattctcatagaatactcatagcctcattatcatgctcacagga<br>gtgtaatggtcttcttgatgatctattagtctcttaagataaaggaatatcaaaagtcgtaaagaatgtaagcgatttcagttgttcctatagg<br>attattggacctggcctgagaagaggcaaggtaaccacgacaaggtcatcgttcagcatcgctattgcctgacctgcctattgcctgactgttttggcattggacttgctgggggtt<br>ttgtttgctgaaattccaatcaagtatgagccaagcagaaaagaccaagatcatcgttcagcatcgctattcctcttcttggttcaataatcttcattga<br>gtaacaaccctgggggattcacttaggcattggcattgcttgcaattcctcatcttcatcttcatcttcgcatatatctcttgaaatagtggagacacaggctcctttgtatta<br>gtacaggatatgcaggtcttaactggaatatgtcttgatttttggtcttcaacagataccctgcaagcatcatggagacacaggctcctttgtatta<br>gtacaggatatgcagttgctgtcatctcaggggacattcctatcttacttggaatattggctttgctgttccgattgtatcagtaataagcct<br>gatgcataggcacatataataaatctccctgtagagccttgcatccaccctgaactataaggaatctctg |
| Contig45_gene_72 | 1225 | gtaatgatttaaccaataataagcattatcacatcatcttccggttcttcttaatgagattcagacagttgagatgagtagatgagaagaacaagatact<br>gcaatcatatttgaacagaagtgtgcggagcattcacagctcttgcatcatgagcacacagatgacagatgacagatgcacgatcatatttcaataactcattg<br>gaaacatatcagcagaagtttcttgtcataagttgtgccgcatccatcgttgcactcgcattgtgctgttttttctgacttcctcattc<br>agtcctccatccattcttgtcgtaatgattttgtgctgagccatggttgtgcacttaagtggttatttagccctgcttattttggcttgtgacattgttt<br>gtttctgatgtatttcttgagatagcatatgagatagcaagagctttttgagaagttgctttattttataa |
| Contig45_gene_83 | 1226 | atgcactgattgagaaacgaactcttcttattggaggaatcgtaaaaagaattgcagcaaaataaagattcgatattaggatatt<br>ttgagtatttttaaaccattattaatcatgatttttacttacttcaaactattcaaacttttcaaacttatatcaatcatatttcaacctatttggcggaagcattgaaattatccagttact |

FIG. 9B-230

| | | |
|---|---|---|
| | | tttatccgaaaaattatctttgattttttaattctgctacatcagtatcaatgatgtcacttaaagcaatataacatttaaaagaact<br>gctgcaccagatcccatttttatatattttcagacacatacaacatttaaatccgataataatgtcattaatgattactgattgt<br>gaccagatcccatttgtttactttcagacacatacaacatttatgggcgttattacattaatgttatgcatctgcaatattctatcaatgaac<br>ctgttttatgtgaccgttcacggaatataatgatttcttttaatcagtgattattttagtgtttgaataatagtttcagaaattgagaaaagattactt<br>ataatcctgaccgttcacggaatataatgatttcttttaatcagtgattattttagtgtttgaataatagtttcagaaattgagaaaagattactt<br>aagtaggatgaatatgttagttcttttatcagtgattattttagtgtttgaataatagtttcagaaattgagaaaagattactt<br>tgaaattttaa |
| Contig45_<br>gene_96 | 1227 | atggttagaagaagacgtcgaaaacgcgaactctgaaactacaaaccttgtgatgcaatgcttgttcttgatt<br>gggattctcatctttgcagttatcggctgaactacaaagcgttatattcagtgatgatgaccctcaggagcgacaggccactgagtcaa<br>ttaatcaaatcactacattgtaactcaaggagaacagtaaacagtactccagacacatcaaaccagtctgagaagttatgtagaacaagtaaa<br>gtttataaggattcgaaaacgggtaatctgattatgttgaaacttaa |
| Contig45_<br>gene_97 | 1228 | atgaactgatattcagctatttgcagtaataagcttgcagctatcctgcttctcaggatagagctaggatatttatcaaaattctttaatct<br>ttcattaaagaagcatttgattctgtactgcttattctataaatggcttttgtcttgccctggctttgtatgtcttgaccctttcattgagcagtcctta<br>attcaacattctatagctctctattattaataatggcttttgtcttgccctggctttgtatgtcttgaccctttcattgagcagtcctta<br>tggtatcctcctgcattgaaatgtctgctattcacttagtctttatgctgatttcacctagtctattttatgctgatttgtgcacgctctctatgctcaag<br>ctttgcattaagtacagaacttctctcttaatcttactatgtcaattgctatattcagaactaattctgtgttctctatattctgcatattatactttatattttgcatactttt<br>tctatctatttcgattttgttgaggattatagagtgactcattatgctatttgcaaatcctcaacagagttgacttaatgctattgagtcaatagttgttatgggt<br>gtgctgggattcattattccaaatatggctccagtatttgggggcctttattagaagagaactaatagattagaatga |
| Contig45_<br>gene_98 | 1229 | gtgattatattggcaatgacaattcctgtgttgatttcctaaccactgacttcttaatttcacaaagtcttttgatcacggtagttatcat<br>actattggttttttgttgtagttgtagttcacttgaggcttatcactggtgtggtctatcatgaataacactcaaggacaaagtatctgtagatgtgtca<br>atctgattctgagattccgattcaggtctgttgattccatgagaggcatttgcccgtaagctcatcgagaatgaagcttcaaaggacattctg<br>cttaagatagcaagcacaggaaatattacagcctataatacacgtatcggcctacgtcctgattgttggtactcttatccattaggtacggtcttgcagcacttggct<br>cctgagatactgacataatttgtccgagtcctgattgttgcatttgatcacactgtagtggtatcgtattcgtgattttatgcttaaacattag<br>aagcttagaaataggtgtatgagagaatatctatctaatttagatgtttatctgatgctgtattgatttatcgctaaacattag |
| Contig45_<br>gene_99 | 1230 | atgggattgtcactatcctattgcttgattaatcctttataacttcacattagttttaagatagaaaataatttatattatataatagc<br>catagacaccatattagtgttatttgtattttattatagttttataaagctgaaaataagattcacttcagcatcagaaactcta<br>cagaaatattagctggaatccctattgacctgatttcttccttccattgacctgatttcttccatttctcaagttt<br>ctaaagataatcggactcttttgaattctttgaaacattgacgtattccttaaaagacccatcttgatgagattttaggattggccattct<br>tgtaatccttgtatcaaccctttgaataatccttgatccaagcataaacagcatatttgacagcctatggttgtcctatccaatcacaa<br>ctgtaggatatggagacgtgcttccaaattcatatattggaaaagtaataggagtttaatattgatatcgagatctaatcttcagcaata<br>acaggagcaatgaccctccatcttttgcaagaaaatctaaacatgaatcagccacaaagaaaaatagataaaatcaataatgatgttgaaaagctttaaagagaattgaatg<br>agacttaagcttcaacaagaaaatctaaacatgaagacataatgataagaagactttatttaatgaagttgtttattttaaatgagaatttgaaaataaatga |
| Contig45_ | 1231 | atgttattgcatgaacaggcattccagttgataggtgaatctcatagttgttttagtgttcttataatcatccatactaattagcctaatact |

FIG. 9B-231

| | | |
|---|---|---|
| gene_114 | | tggaatcatactccttagaagaaacaaattgtattccttcactcattatctttgttgtgaatgtattctattccctttgaagagttggcta<br>atttcttaagattggatgacgctttggttgaccatattggaatagaggtgaggtaaataagccaaagtttgaccagattcctcctgaa<br>gagaagataatcgttcttccacattgtcttagttctagagactgtgaggcaagccttaaggaaagcggaatcaaatgcacattctgtgaaagtg<br>tgcaataggaactatcaagtcaaaggcagagctctatgggatataaggtgttattgtacctggatccagcttgtaaagaataatagagcaaa<br>acaagtcaagtcagtgtaggggttgcctgcctatgtagattgaaccagaccatggtgcacttcagacttcatcctcaggagttcttta<br>tccacttctgctgttttgagacaagaggtgatgtctctaaggtctcaagtcacaattgggtattatgagtataagaaaaataatccattga<br>tgatgaaaggacgactctgaagacgacatagtaggtaggataaaacctagttaa |
| Contig45_<br>gene_143 | 1232 | atgaatttaacttaaagacatgatttaattttatcagaggtttccttatggctctgcagatacaattcctgagtctctgaggaaccat<br>cgcattaatcacaggtatatatgaacgtctaatccatgcaataagcagcataaattcggattataaagccattaatcaaattgacttgccg<br>gatttaaggaaaagctctttgaagagattgtttgaactattcataccctgttttagtatagagtattgcagtttaacctattcaagta<br>ataagatctctttcaaaattacagcatatacattcattcttttaggcttctgcctatattttatacaccaattgga<br>tgaatcaatataagctttatcataacataatcgtataatcttatcatattgtaggttaaaccaattgcagctaacatagcc<br>taattgtattattctctgtgatgattgccatttgcctatgattcactcaatgcctctcttattgcttagtttagacaatat<br>gcatatatctagattcattaattcattaaatttcactacaatgcctacaatgccttgcctgatttatgtgaatcaatgattgtacctgaggctaccttcaatcagatca<br>cccttaatctaccttcttgaaactatgaatctgctacaatgcctcttgtttagctacaatgtttagcttaatctgtcttagagaaaagcttagttaa<br>caagcaattaactgatcttgttaatctgctgatttagctgatttagctgtcttagagaaaagcttagttaa |
| Contig45_<br>gene_146 | 1233 | atgaaaggacatgaaacttaaattacgattatgcttctcttatgctgtctgtctgttcatgtgctgtctgtttatgtactgatcatgctcaggaaattt<br>cctagatacagaggattctacgattctcacgcaattgcaggactattgtcctatccataccatattcggtccaaagattgtttgaaagct<br>ctatggggttcatttactattcgaaagcgaagccctgaactgcaccaaatgtagctagcctaagtgctcaagctagtagctctcaaaacctaag<br>gtaggcatttcaaataccatggtgccaaatgcatttgccaaatgcatatggaagatccaaacatgtatgtgtaaccaaaggaatattaggcct<br>tctgaccatgatgagctcttaaggcggtctcttaggccatggccatgagatatcccatatgcagtgaagatatgccattacaactgttgtagtgccatac<br>cattaatctgctattattaggattctcttaatctctccgaggtggagagacaacaactggcgaggagcattaatcggcttttagct<br>ttgattgcatactccttaggccaattgattgtactcttatctcaagataggaatattatgcagatcgcgaagcgtagagcgttgatgcca<br>acctgaaaaattagctcagctcttagcctataccaatgcaagaaatttatggtgctgcaagatccagagcaagaaatcaaggatgttgaagaaccaaagcat<br>tttctaactgatatcagcaatgcaagaaatttcaagacttatgcgatgtgtattgtagacatcccaggcttgacttcatcgcgatggagttattagcaagaagaattg<br>gatcagttaaaaaaacaataatgtaaagatttcaggttccaataagattatgaaatcgtctctcacacatccagacatgctctctacacatccagatgaaaaaag<br>attagctgatatgaattaa |
| Contig45_<br>gene_150 | 1234 | gtgaaaagatgatatgtccaaatgtaatacagtaacgataatgaagaagaaatttgtaaaattgtggtttgcagctgaatacaactagaat<br>atgtcctaattgtaacactgcaaataagccaaattccaaatttgtcataagtgtggtactacccttaagccctgtagatacatttaaaaaggaa<br>ttatagaagaaataacaagcaattcttctttagtacataaaagatcctataatctgcgcttttagttatttactgcctatggcgctgttaca<br>ggagtggctatttcggtggtgacggcaatagtggatcaattcaataactttacagaaaaccagactgacacaatgacgatacaatgacaatcaga<br>tgccgtaaatcatgacaatgtaagccaaactgaagccaaatgaactgttcaaaatcagacagaatcagcaataacagataacaaataaaacaaagtctattct<br>ctgttgaaaaagactaacaactacaaagttcagcaaagtcacactgaaaaagcaaaatgcaactaa |
| Contig47_<br>gene_1 | 1235 | atgaagcatagatcctatgagtttagataagaagaccaaattatatttgttgaagaaataattaaattatgattcaagaatccaaacaaat<br>attggtatcctatgcgattttaaaaactaaacagaacaataatatttgcttttaaaatcattttataagcatgttcttgaaattgacattccattca |

FIG. 9B-232

| | | |
|---|---|---|
| | | tcctaatgaactcaaatccaatagaagactctgcaattccttaatatttctgaagttctgactgcagatcaagtttataaatcttttcagaa
ataaactctgaaaactctataaatcattaaacagaatcttaaacagaaatatggtcaaaaggagagaaaaagacttcattgtcgatgc
gactccagtggactggatatccaatttccgcagaaataaaagagcaacatctcaaaaaattgaatctcaaatggagttattcttcccta
aaggttattatattgattttaaagcgactgttgtgatggatcttcatgaatcctgtttgcattttaatccattctgagctccaaatgat
gcaggactttttgaagagattttagaaaacctcaaaaagagcgaatatcagaaaaggagatacattaatcttgataaggatattacgcta
taaaactaccaaataggaatcagcaaatacaaagagaataatggaagaaaaattcagcagaacccgacttgatgacatttaa
cctatccactagccgtatttaacaaacaaacaaggcaaaataaggggcaaaatagagcaatctaaaacaaggcttgaatatgagaaatccacaaatatac
tcataaatcagtagaaaaaccgttatctaaatgtattttttgggacactgattatatcacaagatttact |
| Contig47_
gene_12 | 1236 | atgataggtgacgatgacttcttatgcagatcgacatcactatgagctagcgactcagagagatgtatgaagaggctatgatgctc
ttcagactatgtccagatactcatcaggaggcagctagtgatcttcctgtgtcagaaagctcagaagactagcttgaaaatactgcc
ttataggaattctcaattgttctggagtagttgtttgcaaacattgcattccagcaattactactcattgtccagttcagtgacagtggat
gattgaatatccgatacatctattcaaaaccagtataaaatcactaccgattatgatatcagattacataaaagagaagcta
tgccagcatgccacaagtctatttctattcgaaaatggcagactatgcaatatttgtataatgacagccaatatatgacaactgctatctgggaag
tgccatacataatctatttgatgaaagcagcagactatgcaatattttgaagtatataaaaacccaattgattctgtgatgcataccgtgaa
agagtggatgttgataataaatgtataaaagagtttattaattattgatacattgtatgattaa |
| Contig47_
gene_21 | 1237 | atggcagaactcatgcacaaatattgtagtagatagtgatgataacacattcttgcaatactattccaatagtcggattcggagcattatata
cttctgaaaaggaagatgcattctaccaaacagccatgcaaacacatgataatcattgttgttattgctatgattgcaataaatatccttttaattg
catttgcataattaccatacaccgtgggacaggttaa |
| Contig47_
gene_22 | 1238 | atggataatagaaatatactaatcattattgaataatagtcctaatcgctgcagcaggattattctagtgatgttaacatcagaaaattatga
aagaatggagatagtgccaaacggacagcatagatgttccattaaacaagaccacatatgatgagaattcagagcgctagagttggcatt
gggacaaggaatagtcacatacaatacgatgtaagcgatgattaccctcttatgatcgcgacgttatcataatcgtcaacgacaggaggcagttc
acattataccggccaaatcaatccagtacaagaatgtttttccagtaaatagcagcgatttcaataacaacattgaaactgtgggagaatctgagcgaatatctg
gagtcaacagtaaaatgactactgcaaacagtttgacaattttgacactgatttgaaaacctaactgaaatctagagtctagcagcaaa
ggattatgtaaatgatgccaatttaagtgatgtgcaaaacaacagtggaagagaaaactgaattatattgatgatgctaaatccgatttggagc
aatacattgaaagttgacttcataa |
| Contig47_
gene_26 | 1239 | atgccattggataatttgaggatatatgaagtatacaacaaatataacattttctttaattatttggtttattctactgttttgtat
gttcatgcaattttttgatgaaatgaggatatccatgcacttatctgtcaatgatacctatatatttcattgcaggctatgaatgctataa
ctaaagatgtaattgataatgtaagcgattgcctaaaatattaataagcaaagatgtcattgtttttgggaataaaatcaactgtgtttattgta
tatctttctgttcaaggatatttttttccatatctttatcatatacgcttgtaaatacgtttggatgttttgttgcagtattttatttcaccatgtctcttcatgg
aacagcaccttatttattcatcataatctttgtaaataggctaaattttgtgtatttttgattaagataaaagattatatgagactggagaga
aaaggattagctaaattagcagacactgtaatttatatttttgttcattactacgtaatcactgagagactccattttttgttcttgattatat
ctatatgcgaaacattaataggtttgactttataagagctgtgtaaaagactccaatttgatataaaattaaaacaactaa |

FIG. 9B-233

| | | |
|---|---|---|
| Contig47_gene_35 | 1240 | atggatatattagaaaagtaattgaataatattattggtttaatctcatttgcaatctaccagtttacagcgcccaagcagtctcatggat tgaggagtagctctaatagcattggtattgcttaatcctcgacgattctccatatgagcatgatgctgagtttcagcagcaaaatat tgctgggaatcatagcagccatatcggattcatgtcctatataaagtgatgcattatccttcattattgcatatcctctatataattga tttatactgatattgtcggtttgctaggtatttttatagcaatagatacactgcagtttactcgttgaatatgacttaatcttagtataat atgcattatctgtgctttctctcacttcacagccattatacactgcagttatcgttgaatctgtatgataatgaggaataaccttcctag caagtgcataattgatgaatga |
| Contig47_gene_36 | 1241 | atggataaagaacaaagaacgtctaggagaaataacagagctgcgatgaagaaatacggctttgataagattttaggcgaaagcgcaaaaacag gatacgcggaaaagatgaggaagaagagcctcctattgataggtaagttccagtcaagttcagacttatgcttcaggaacttgaacaacct catcaaactaggccagtcttaagcacaagcctgacatgtagggagaacattgcaaacgagcttgcaaccttcaggacgacaaccctgca ataagctatgacgcaggttaagcaatagttgaaggagctgaaagcattgacgacttctttgcgaattctcacatgagcatcttgcaac cgcatctatgacacaggttcacgaagctcacctaaatacaggggagcatgtcagtcaagatcagaaaagaggaatcacagacaagattgacc tggataagataataagataaacattgcaaacgtgacagcagacagttcaagcggcagtctcagagattgagacaatctccctgagtgatgaagagttc gaccgcagcatccacaaggaaatactgactactacaacgtcagaatcatgacaagtgatcattgtgactcttctgtagacaatcaaatgtccacat tccagcaacctatcctaaatactgcaacacaaagtcctttacaaacagtgtattgctccttggttcctcaacagcttctcatagacgattcttccatgagaccacccct acgaattgacaagatcatgcctagaagacaatgtgtgtgctcacctggtatgtgagaaccttgacagactttcaaacgcaacctcgcaga gcaatcctactcattgacagagacattgacgagtaatcaaccattgatgacatgtacatgacatcttagact |
| Contig47_gene_37 | 1242 | atgacagaaatagattgttttaaatttgaagataggattacgatttccatttttataaaaagaatcccatatttcaaaaatggctgcttgt cttattctttgttttttataatgtgatccatccttatcaatgacgataagcttcatattgcatagtcttttatcgtccagtat tatatttcctagactggactataagcacaatatttagaaagccatctcaaggacattgccttgcagtgcctgaatgtcctgagtcagtat tatgcaataattatggagcaggcaatattggaatctgttggaatagctcaaattccttcattcttccattctcttaatgtactacagtact attattaa gagcgtctttcattaatgggaagaattcatcaagttcatcaagtcatctttgcatgcatcatttgcatcatcaagacaaaaaataattgttcctatataaccattattgtacagatgcatttatctt tgtctgtggtgattcagtcgatcgatcagtttatgcatacaagttttatgcacatagtttcatattttcctatatatatatatctttcatacaa ggctttgatcaattttttgagttttttgcatacatcaagacaaaaaataattgttcctatataaccattattgtacagatgcatttatctt tgcaatgctactgcttgacttgataa |
| Contig47_gene_41 | 1243 | atgatatgtccaagttgtgaagtgtgaaataaggaagttctaaattctgtaaaactgtggtgaaggttaactgatgatagttctagacctaccag caccatgctagtgcttcatctcaatcaagagcaataagaatcttttgattatctgtgtcaactataattactgtgttgctgttggtcagggg ctatcctttttatgagtgccagtccactgattatgaggtgcaagcgtgagctactaatgatcattcatcatctgccttgaatcctatgac agttccaattcaaatgattgagaagtcaggatgattcagcacaaggtcagttattccctgaacagtccagtctgaacactgttacttcatgttttctatgaaggcagcattgacggaaatg gggaagagttcaagaagaatcaagaagcatcagaatcagaatatttcctgaacagtcagttgttacttcactgtaaaagcattgacggaaatg gcttttgactgacacgagttttaagacttaagactttgcagcttgcttacttgcagttttaagacttaacattgatgatgacattgatgttgac actccgaccttggagggggatgaacagtgaaggttagaacaagattgcagatcatgcagttgcagttggcagtgatgatgatgcagtgcagtgtccgta ctgtgctaaaaaggtcaggaacgtcaggacagtagaaccagaagcggttcaaccagatatgtttaa |
| Contig47_gene_46 | 1244 | gtgtctaaaagagaagataattgtcaaatgatgattgctctagtgaacttgtgcacctgtcagtcctgtcgtcctttcaaaagagggatatatttttt aattttcatcattgttttattcatagttctgttttctattcattgtgactaatgattgattaa |
| Contig47_ | 1245 | atgacaaaactatataaagagaagtaaaagggaatataacgagagaagtcctcaagcttaagatagctaatgctctcactttacaaa |

FIG. 9B-234

| | |
|---|---|
| gene_58 | tcctccgattatttgtattccttgttttattgattcattgtgcttgcatctaacgaaatccgttttcaagtagttcagctttgactga<br>tgctatttgccaaatgcgagatcattcacttgtatttgcatctgtcctcctatgcaatcataatctactgggcaaagaagctgaatacagat<br>aaggacatctcaaatcgtgaagatcgcttcattccctatcgtagggtgttgtcctacctgattgcttgtaatatcattttcttcgaatt<br>gccaaacttcctgacaattctctctcttatgttatgcagtaacacattcattgtcatgctcattacaagcctatgaaaataagcatacatacaa<br>caggattaagcggacctgagctgcctaatcatgcttctgccttggacctattggacttcgattactgtgactgtgtcctactgtcctagtctggagcagg<br>gtcaccctaaaagctcaatgctcagcagctcagcagcaatattgcttgtgggaatattgcttgatcatattgcctgtattcagatgatctttatatgcgcct<br>gttttaaatgagcgttccaggcttgtgcgttagcgaatcagtataaggcaaagctattccaccttgcttcatcgatttcagcattctactcgga<br>gcctttgaaaaagaggacttgattcttatattaagcgctatagtaagcgttttagtaacaatatttgcagagatacattctcatgtataaggggat<br>cagcagaggacttgaaggaaaacctaatagtgctctcacttgcttgcggtctgattctgatatgtgg |
| Contig47_<br>gene_65 | atgaaagaaagtatgctctccagactgtgagaaagtattagaaatgaatcagaaaacattagaaaagcagaatcatgttatttgctgtgat<br>tgttgtctttatctcgtatgggcatatttcatgtctcttaaataa |
| Contig47_<br>gene_67 | atgccatctgaaaaagtgaaagaattaatgaaagcctaaaacaaagagaagaagacaaatcttcaagcaaatattttgtatagctattgg<br>aacagtgtaggtgtagccacatatctctgcttctgctatactttaatcttcaatattcgatgaatattgcattgcattctcatttactgtctactg<br>caggatacgctgaaagcattcttgctaaaaagatcctaatgagagcacagttgcaataagcgcattcattcttcatcagtagtctac<br>ggattcttcatatccaactctaccttaggagtgggaatccataataattacgacagcaggatgtaattattcaagcagctatgccatagcactaaca<br>ctatctcctgcttgcagtaggagtggaatctgaaaagagctgaagtgaaaagtttcttaagaagttacattctgccttatataaggatatataaagaaaa<br>tatttaagaagcaaaaaaagagctgaaagatctgaatatcagaagacaaacaggatataaccagacatatttcggttc<br>ttaggagttcttatatgacactggagtatcctccaaagaatcatcatgggaagactcctgatgatcatttgaagcttctatgcatagttgcagatggttc<br>caaacagaagaagattaaagagttaaagcgacgacggatgtatgttattgaaaagacaggagaaatactgg<br>aattgattaaagaggttatgagagaagactggtattgttattgaaaagacaggagaaatactgg<br>gcacaagtgtttatgagagaagactggtattgttattgaaaagacaggagaatattaa |
| Contig47_<br>gene_68 | atgttccattgcagttttcctattcacttcagtcgagttgaccttccctgcagttcctgatggtctctcttggaaccagcctgccatcattat<br>tccaacggcgtcctcgaggctctcagagcctatcagcagcatcagaagaagaacaagtcctcatggttgtcagacaggaataagattacgtttgggaattattgggg<br>gatctgcgaggtcttttagcaggcattaaatatgttcctacagaatcctgcagatgatattgcctgtcatcgttggatgatcatctctcgatt<br>tttgctccaggtccgatgggaagcatttcaatttgttaaatgaggtatcgttggatttccataggaatcatcctctgatt<br>gcttggcgttggcgaggagtttgggggcttttgatttttgatgatttcacacaggtttgagtaaatccaatgccctattgttgactcagcttatgttgaaccatgcctattgctgatcatctgatagatgtatgattgtttaagtttgaa<br>ttgcatttacagcagcattggggcttatatcatcttacacaggtttgagtaaattagtttataattgctgagaaagattaaaacaaatcttct<br>aactttgtagtgttgattgtattgttttcagtcgatgcgactataggagctaaattagtttataattgctgagaaagattaaaacaaatcttct<br>tgcaataatttgatttatatgcaattaaaatgcttgatccaattagcatcttgttagtctataa |
| Contig47_<br>gene_69 | atgaatttaaaaataaacaaatatattccattgaataatattaatcatacttgaggtctttatacttcttaagtgcatagaccaattcat<br>aagaccattaccaacctattcctgagctctcaatggctcctcaaagggtaaggacatactactcttgttctcatttggaataacaatcatctgtcctcca<br>ttggagataatgagaggattcataactctcaggattagctgtagaattgtacttaagacatctgcttaagagcatcttggaatacaatacttgtaatcatgaa<br>tcctagccttacaagcacaacagcttctccattccatttatataaccatttatataaccatttctcattccaatttatataaccatttcctccatttatataactccatattccagcag<br>gaatccatacaggaagctcattaagtagctatgcccaagtgtgataagcctgctctttatattgattccaataacttatattctatgttcta |

FIG. 9B-235

| | | |
|---|---|---|
| | | tctaatcaaaggcgaaggcagcttctagaatactttagctttacaagcactcttggaataatcgattgattgacggagcctcttgcaac
tcctgcaatcggaaggaatctatggaatcctttatattgatgtacaaggattttagatgaagagatttcagactttataactgaaagacaaaa
gagatggaataaaagaaaattaaatgaggaattaaggcgattaagtcgattcattaacaataaaaatatttgaagattgccttg
cctcatattgcattgattctaataatcatcttaagttctctgttgcattctatgtgcatgtccagattcttatgaattcttatatctaatgg
ccacgatcttgatttagatgaatatgatacattaaatatatcagaaaatgagataggactgttgttcatcttt |
| Contig47_
gene_79 | 1250 | atggttaagattagtcgtaaaaatagtttgataaagcagtgaagcagacccctatgtcaggtgttgccaatcttgtggatgcatgttggttat
tgcagttggattgctgtgtgttttagtcattagctgagttgaagtggatcaatatgcgaatatgcaatctcatcatcaatgaggatctatctcccagcaaagcaagaggcta
ttgatgccatgaatcaggttattgaagttgaagtggatcaggggcaacaattaaatgagactccagataaacgcaattcttcaggtgaaggctataccgaa
atgggtaaggttatcaggacctaagacgggtaagctgaataatgattgaaatattag |
| Contig47_
gene_80 | 1251 | gtgggtgaggaattctaacttctagacactcttagtcaaagttacagattccagtaatcatcatttcttactatattcgctgttggagc
aatcatcctttaggaggcctaatcagagaatatagtcatagagaacctccagatgctgaatatgagaaatattattgatgcaatcaacaagg
ctaatgacaaatctgagattttatccatgtagactcttcagatatttcaaactctcaaaagactgttttaagagagattctgactgg
gacaatgaatcaagagtgggccttgctaaaaagagactcgaaaaagcgcttgtcatacactgacatatcactcg
tatcggtcctacattagggcttatggaacactcattccaatggctccaggtctgctgcatatggtacaggagacgttgtaacttgtcaaatg
caattattgtagcatttgataccactgtggtaggtatcggttcaggtgctctgcatatgtcataagcaagataaggcgaagatggtatagcgaa
tacattaacatattgatgttttaactgatgtgtattgaataagcttaataaattataa |
| Contig47_
gene_81 | 1252 | ttgggagaaatgatagatcttgtcttaattcttcttcttcttaggtgataataaaataatgacttagtaataatgctga
tttgaatagtttaaatccaataactgtcctgacagtttgctaaattccaataaaaatgaaatatatgctattgcaagaatcaacagatcttaatgatg
atttaaacgattccagataactgtcctgacagtttgctaaaactctggaaaactcagtgtttcttgatgaaaataaccgcttaaaggaagattatgggatgcac
gagcgcaataatcaaatcttcctgataagtcctgagcttggcataatcgacataatcgaatcactgcaatcactgcaaaggaaaactcattcaagaata
cctgtatttgaagggattctgcatctgatatcgaactttcgaacttccaatctaaactaccgttcagccaataacaaacgatttgcatctacagcaaaagtgaagg
gtctatctgattacatactagcatctacaattgcttccttaatcaacaacaatcactggttcatgatccaaagctgtaatgatctaaagcgtcattatgcaaagctgtaatcaatacctatgttacagattccaccca
ataagacagatgtccagctaatgcctgttgtctgctcaagctgtaagttcaaagcttaatgttatgcaaagctgacctggattatatagggctgtc
aagctcattgctatggattcatgcatattatatgattgcagtgacttactgtcgaaaagaaacactctttatc |
| Contig47_
gene_86 | 1253 | atggctgatgaaattgctacaataataagttcctaggacttcctgagcatttcttttagcgtttgtagttattggtgc
aattattgtaattgtcgcaactagcaactttagatgtttaccatactcttcatcctaatgcaagagtaagagcaagaaagagattgtttg
atgaaacagatttcagaaagttcagcaaacagttgaaacaaacgttgatgaaaccttgcattgacatgcattcagctggtgaaacattcagcttggtgacatgtgcaaactgttccaagaatgcttccctaaagagatgctgcctatgacactttcattaa
aattatacacttgaaaagtcagacatcaataacattaaagtttatgactgctaagcaagcaggattaaacgaagaagcaactgctgaccttttaa
agtatgctaaaaagtcagacatcaataacattaaagtttatgactgctaagcaagcaggattaaacgaagaagcaactgctgaccttttaa
ttcctactgttccttatatggaagatatagaacgtttgaccgacgctgatggtgttcacgttgttgcaggattgcgttgtgcaggattagataacgct
ccagtatattggaagaagcacttccagaatatgaaaagactgaaaagataagcagatactctattcttatgtcggtaatcagcaagtgatgttgcaaatatcaaattaatattaa
cgcttcctctgaaacccatctgatgagaataagcagtatcagccatacatgattgaagctatcagcccatacatgattgatatgttgatatcagtgatacatgattaagagaatgaagcttaagagatcttatg
gagcaaaggctgatgattagactatcagccatatcagccatacatgattgaagctatcagcccatacatgattgatatgttgatatcagtgatacatgattaagagaatgaagcttaagagatcttatg |

FIG. 9B-236

| | | |
|---|---|---|
| | | gaagctgaagacgtcactgtgtcattccggtttggaaggaaccaaatactcagacgtccttgttgaagtgcttcctgaatacaatgaaactgg atctgtagctctcttgaaaaggcttagacaagcttcagaagttcttagtgactgtcagacaagcttagacttgtttggaatacaatgaaaagc |
| Contig47_gene_88 | 1254 | atgtagaaattgcttagtgactgcttagtcgttgagctgtagcgctagcagaagataacgatggtgctgtagcaattggtgtttgctgttaggtttccggttaggacaaggtat gcagcagctgatctgttggagctgtagcagaagataacgatggtgctgtagcaattggtgtgttgctagaggtattatttctcagcattctcagcattaggacaactcaggctattt acggattcttgattgctattttattactgatattctcaggattatgttccggttggacaaggtctccacactgcaggtattgtacgtataggt gtaggtgcatctattggatttgcaggttaggttcgcaagtctatttggacaagctactgttgactgtggcagcagcttcctctgttggtgctatcgtcgagataacga catgttcgcaagagtatcctctgcattacagactcaaagctattacggttcttgatttgctatctactatgctatctatgtcggttggaa tcttaggttag |
| Contig47_gene_89 | 1255 | atggtaagcttaatgttataacttgacaaatacgtgctcctacgtgctcagtgcactcacgacgaggtattgtccaaataatgatatttc tgaacgtattcagcaagatcctaagctagcagaacttggtgaaaccttcaaaagttacacctttatacctgtaagctgtcctcacttctatgaaga caagcgcacttccgatctctcggatgcccttcaggtcagtcccttaaggtcagtcatatgatctcttcaagcccgatcttccagtt cctaagaagtcgagatgttgatacagaagaagttttatagcttatgatcaacattaggccagtttatagcttcaagctgtgagctgaaacaagttgaaga taagtccgtgtgtatacttctaccattgtgagaagtaaagctagcagcgagctgttgtaggagcagcagctgtgtagcttgacactttcaagtgaaacactgaagccgtaatacagtagaattaccagatcgagat ctcttttcgaattgtttacgaatagagagaatctaccaagtgagaagtttgaaactgaggattgtagtagcagctatgagtgatgtagttgagcttattcctcttgcgaatccaggcttcaggctatcg aagtgaagaaattcgaacaatcccaagctaaggctgatttgaaagtgtagcagaaccgacaaagctattgaagagcttgttgtcttgctttaaagaacaattgaaaacgaa aagagaaaaagaaaaatgagggtttcgcaacatgaggtgccacgtgatcatgaggtgccacgtgatgaacaatcgtgcactcgaagaaaggttccagacaatgctgaagacg aagcataattgagactgctacagtggcatcgcagcagtttcagctccttttaatcattcaggctttggaattattagagttattagggttaggctcactaaaccaagttagagacattat |
| Contig47_gene_91 | 1256 | atgagaaaaattatattattggctttcagctctcttaatcatttaggctttggaattatatgagtgtacctaaaccagttagacattat tgcatcatccctgtcgttgtatctcatcacattctagtaagtcctatcaattctgtgttaaacaatctgattaaaagcagctatctcattgacgat tggtattgtacttgtatctcatcacattctagtaagtcctatcaattctgtgttcctctctttgaattattttggttgctatagctgttta gctatcttagaaaattaccagacaataattaagatactttctacagatcttaa |
| Contig47_gene_92 | 1257 | atgaaccaaagtagttcgtgcaaggacaaagagttaatgaataatcaattgcaaagctttttgaagagtctaaatacactgtcaagtcccagga taagaattatgtccttcttaagaagaataattatgaaagtcgaagaaattgatttactgttcttcatattgatggactgttcttcaatgcattgcta ttctagttaatgtggcctatttcgcctacagtgtttttaaaagtccatgtaattcttaaactgacaagaaactgggatagggcgatagaattatctagattgaataa ttggaattcgatgacgtcggtgaaattgaagtattctacgaccaagaaactggataggcgatagaattatctagattgaataa |
| Contig47_gene_99 | 1258 | atggctatcggtcgtgtaaaggagattaagattaccgaacaccatcagtatcctattattaccttgattatgcctgtttaggtttagcccttta tttgcaaagcctattaagttatatggcagaaagcaatctaaggtagctgagggctatgttctattatttgtgttatttaataccaaattgg ctatttcaagcggtcaagccatagccagtatttccaagtgggcctgtctcttctccttgcagcagataggtaattaggtactcttatagcattg cctatagcacttttcggcttagaaggaggtatgagatgaggagtcatcggttatttggctgtttttgtttatcggatccattaggtactccattcatcagcttcctatcaagcataa cggtttaaatctcagagaccgcgagatattcctatgcctatgcctagtcaggtgcttcaggtgcaagcgcagtgatgtgggaagcgcaagtatgcctgcttcttttgatg gcgcttcactgattccatcaatgctactgtttcgcgatcgttgagcctttgccgatgcagtaagtggcatatatagcatcccctcatataggcctatataggcctttcattctgttttcggtatctatagtgtatattgt atcattgcctcttgcagacgtatgtaagtcatcttaagaaggagttaagtgcaagaaaggttcaagaacattgagctagaagaaatgtatttcagaaagaagatgtacattaaaagatggctacattccttctatattctctcattcaccgtt ggtaagcatgaatgatactgcatcctaagaagagttaagtcaggaagagttaagtgcaagaaaggttcaagaacattgacgatgtagcaagaag |

FIG. 9B-237

| | |
|---|---|
| Contig47_gene_100 | gctgtaggaaattatataggatatcacacttcattgctgattcattcattgaatgatcattattcacttataaccattctggaatgtctct tgaaggataattcctggaatattcaatcaatcattatataagctgattgtataattgtgctattcag |
| Contig47_gene_103 | atggagataacaaccaaaggaagacaacaatgtggagttatactcctccatggaggtctctttaattgctctatccgtttttccctaaa tggatgtgaagattga |
| Contig47_gene_116 | atgaaaatcatgcaatttcacgtaaagaatttaaagaagaagaatttgatatgaacttaattcaaacattaacacattaatttaatcatagc aataatttgcagttattatgacctatatgactggaataaaaacccatcattattggacttgcatactttgccataattgtaattctagcta atttatacctaagcttaaaaataag |
| Contig47_gene_116 | atgtttgtgaagattaataataatttatcaaatttatgaaagcgataaaatattaatttctacaggaatatatttcttaaa ggcggaatattcacttggcctcaaatcattgttcatttcattgttttttacattgatattggctttgatgattgcattgttat ttcattgatattcttatgcaattctattggctttttcaatttcctcttttgtctttattcatttgttttatataaatccgagcgaagaagg gaagagcttgaaactcaattccggactttaagacaattggcttcaatgctgcggttggaatggagtctctttgattggt agcatggaaacgccattatatgatgagctgcgcgtgtttgttgagataagagatgggaaagtctttgaatccttaggaatatgg cgaaaggcttgactcaaaggatcttgacgtagtttaaaggaaagaaaaatctgtcgtaatgctcataagatggggaggctcgttgattgtaagtgat gtcagtgatgctatgctgattttggagtcgtcctgattttggcaggatcttctatctcgattgttggagtctattccatcatgtattgacgatcaagtgccatctgtcaactgtgcccaacgg ttgctctgatctctgatcattcattcgatgattcttgttcttatctttatcatgtgctttgactatcctttcgattctga attccaataaccgcattagcattttttcttattttatctttcaggactatcctttcgattctga |
| Contig47_gene_123 | atgaaaatgaatagattattaaaagaattggattggagcattgtaggagatcttgtagatgctgcttgaacatatagccttgg tccgcagaacgtcagctttccggaactgaaatcttcaagtgcattaatgtcattctgaatgtcagcacattgcttaggatcatgt atgaaaagaggacattcattcaatcaagtatacatggaactatatacaactcaattctgtcagtcaatgtgatcatgtgctagctgg atgcctattagcttaggcataggcataaaagatagaattatctaatgattttgcttaa caacattcctagcaaggacattaataaaagatagaattatctaatgattttgattaa |
| Contig47_gene_125 | atggataagaaaatgattgttttattctgaagcaaggctttccttgtttattctgtatttgatgaagcaataagactgaaag taaagtaaacttaatcgttttattctgaagccaaagtcttatctgaacttgtcaatgaaattaagaccaagactatatgaaggatatgaca atgagacagttgcctgatggagtcttaagctgagagagcttttgaatacatcggcagatagacatagttatatgagcgaactgatgcaagcaag cttctcctgtctctcgttgctttctcaaatgcagctttgtatgcaaatgtgacgaatataagtttatatgagcgaactgatgcaagcaag gaatgtctgtatgtcaagatgaataggtaaaatacatcggcagagaatgtaactttttcaggggttaa |
| Contig47_gene_127 | atgaaggaatattcttaagaatattgatgaaataatccaattgtagttattgttctaatagg cataattatctttctttccttcacttttaaggtgatagatactcttatgcatgttggagacatttatgcatgttgccattgcca atttgataacggctccactttaaggggagactatattacataggaactgtcactgaatttaaaataacgatttcaaatgagca tttgttcgagagaatctgcggaggagacggagggtttttaatggaacatatttcaggagatatgttgtcggaaatgtggtttc aattgcgactgacaatcctaagcaaggcaaatttgatatgtttgcaagacaaatctgtagcttctaaactaacagattctgctgaa acagaatttacatggcatgaatgcaaagatagtaaaataatcgattgggcagcttaaaggttggggaattgcagaaggtcttgcatca ggttccagcaactctctagcggagcctatcagctcgactctgcccaaatatcttcaggtctcacagcctaagca agtaaggacgtaaacacaggtagcacaggagtaaaagcaaagctttaaaaacaagcttctgatttggatgaaggtgcacaactgttcaagagg gctcaatttataaaccagaaatcagcagaactttcagcaggttccgatgaagtgcaggctgccgatcagccactgatcagtcctaatgcctgatgcccct |

FIG. 9B-238

| | | |
|---|---|---|
| Contig47_gene_147 | | gtaaaagactatgtagatgccagtgttgaacttgcaaatgaagttgtcgaactggctaaggttcttcacagttagcaaacggttctgttcaatt<br>ggctaacggttctgttcaattggcaaattggctgacggttctgttcaattgcgatggtt |
| Contig47_gene_150 | 1265 | atgttagacataccaaagaagacccctcaagttagaagattcattaaacctagttaaagaagaagaggattatgaaaagcttagaagaagt<br>tgagcagactatatcgatgagcgagattgagctagcttcgattcaatcaaagagagaagagattataggactttatatattaagacatcctc<br>ctaagaacatcattacttatccagggtccaattcatcatcaggtccagttcaataaaagacagtccagcaaatggatgattaaaatgttat<br>atgagtgttttaggcccattgataataatccttgcaatagcaattctttgggagttttaaagaggggtaa |
| Contig47_gene_151 | 1266 | ttgaccctgcctgagcatccattgtcttgctgagttgttgatcctgagttgttccctttatacatttatagcatatgatggctgcattcgg<br>tcagatattcttctcattgagcttggaatggggctgattttacatttgcaagctataccaaaaggacatagacttgatttcaagtgattat<br>gtgttgttttgctaaatagtcttttgaaaacttgcagcattagggttttctcaattctagatatatgtccctgagtctggagttgctgtt<br>tcaaagcttgtatcacagttacaacactgattttgttcatatccaaagttttaatatttaggagttgcgcttgattttaggccact<br>attctttttactagttttatgttgcaggagtcacaagcatattgtcctccttgaagtgcttcaattccattcagacaagttcgcttttcaa<br>ggaaaagctacaaccgctttatgcagttgaggggctggcttcagtgttgagctctttgccacttcagctgtattcaaggctgttagcattgcagac<br>atatttgtaaataatattatggtttttgttttcaggaagatggtggttcagttttgccaatcctttgcatgtattcaaggctgtggacttttt<br>caatgctaaaagccgatttttaaaactgggttcaactgaatttgtagtgatttgcaactgaatattaggagtattgctgcaatatatttgcattatattaca<br>aattatataatcttataaaaatgggttcaactgaatttgtattttaggagtattgctgcaatatattgcattatatttaca<br>atcaggccagcaaaaactgatgatggttaaaaccgaagagaggattaagtaa |
| Contig47_gene_154 | 1267 | atggctaatgaaaatgaatgggcagcaatcctgcatttgtcctgcattgttcctgcagttggattggaaatatctgagatatccata<br>tgtgcttattcaaatgggcgaggcgagcctttcacaaaggccttttagtttagcttttagttttactcctcatcattctagaatatggg<br>tcgtctataactataagtcctcattcaacaggctatcgtaaaataaagcctaaattgaattttatgtttatgggctgggatcagatccaaatacatt<br>attatgacaatttactattcacccatattggctgggatcctgcagattcaataagtggcatttaaacttcattccagtcattgccatttcatatggctca<br>tttaacagtttgcctattgcagtctgcagattcaataagtggcttaggccgtgttgccgatactttgttccaaatgccttttgttataatga<br>taatatggttcattccatagaacttggatgaagcttagcgtgttgccgatactttgttccaaatgccttttgttataatga |
| Contig47_gene_157 | 1268 | atgccaaatcaaatgcttaaagttcagtcagtattgtactgaaatataaacctttattttaatcgtattcatccaattttaatatttgaatg<br>cataacaataaagtgggtggaataatgaaaaccacctcagtagtccttttagttattttagttactcaagacgtaa<br>tcaatgaggcaccagtctgcctaagataagccttaaggaattgctcaattcggagtgaaaggaaccatcgtatatacattctatctgaccata<br>caagcttccctttagtttgattcctatcagcttcatcatctattttatcacgagaccatagaatt<br>gttttttgagcatgatcctatcagcttcatcatctattttatcatattgacttaaaagaatcaaaagaacatcggttgaaatcgctcttg<br>caatacagcagatggggaaacactaaaagcagcatttgactttaaagaatcaaaagaacatcggttgaaggaatatgctgaa<br>gactatacaaagattgtagcggctgttgttcattttatcaatgatatttcccactcttatgttggataagcattataatagggagtatt<br>gactgatatttttggcattacagtggaatatcgtgaattggaaatatttataggagataaatcaagagacagccctcgagg<br>atacaagcaattaa |
| Contig47_gene_157 | 1269 | atggttgttcaagaacatatctgcataatgaagagaaatccaagagcatagtctccaattaaaatctcttgaatcagatgccgatttcaaaga<br>caaaagaatggattatatgaattataccgcaaaatgaaaatcgataagttgaagaaaaattagatgttctaaataacaatatttattgagaaatt<br>cccaggaaaacaaacaaaaatggaaattaggctaacaaagatagaaccgatatcaaaatcaaaaattagaatcccaaagaagaattgcacgaatg<br>ggaatagctctaactgcaattactatattaataacatttatttcaagataatgcattaa |
| Contig47_ | 1270 | atgagagaaatcccacaaatatactccaaatcagtagaaaaacgtttatctcaaatgtattttttggagcactgattatcacaaggattta |

FIG. 9B-239

| gene_163 | ctcaaaaacgaccatacaacaattatctgaaaactaa |
|---|---|
| Contig47_gene_165 | 1271 | atgaagcatagattaaatttagataataaagacccaattatatttgttgaagaaatatttaaaattatggatctagaaatccaaagtat<br>attagcatcctatgcttaaaaactaaaatagaacatatttacttttaaaattatattatattatagtatgttcttgaattgacattccattca<br>ttttaaacgagcttaaatccaaaaaagaacttgcaaatacttaatattctgaagtttgactgcagatcaagtttatatatttttcagaa<br>ataaactctgaaaaactttataaaaatgtttaaacagaatcttaaactcaaggaatatggttaaaagaagaggaaaaaaacttttattgttgatgc<br>gaccccagtgggacgtagatattaatttcacacagaaatgtttaaacgaatccaagaaaatcaaatgagttattcatcctcta<br>aagttattatattggattttaagcaactgtttgtattagattatgattctatgaatcctgttgtattgtatttgtcccactctgagctcaaacgat<br>gcaaaacttttcgaagaaattttagaaaacctttcaaaaagcgaataatcagaaaagagacacattaatcttgataaaggatattacagcta<br>a |
| Contig47_gene_166 | 1272 | ttgaatgaagcattgactaaattgctagacctttatgcaggattatataatgtcattctgcctaatgagttcgtttcaatggctagaggaatatccat<br>gattgaatctgttgccacccactagatcctaaaatagatgcatggcttccatcgaaccgatagtcaaagaggtaatgaaggataagaatgaaca<br>ttaaggaatctctttcaaacaaaaaaagcagttttgtttattataagaacatgcttaagacacttcctccacttttaacaaacagcgttcataag<br>ataaacaatggagatatgaagcttcgcttttgaaatgacagatcgaccatattgaagcaagtttcattgtttgttataattgcagccctct<br>gatgagctcttcaataactactagaccatcaataggggccaatgtttattgacatgccttaattgcagttttaggctatatagtgactttattt<br>taggagccatagccgttgcaaattactacatagcagataa |
| Contig47_gene_172 | 1273 | atgacacaacagaatggcttttatcaaatctctactaaatctgcttgatttaagcacaatcatatcaattattgtaataatcaattcatagctgcagcaat<br>aatcataaagctaggagaaaatcacttcttctaagaataagaataggatgaaaaagtatgaaatcaatctactgccattatctcctaaaagacatcctaaat<br>atgaattattataattgcacttgcttttgatatctgaatctaattggaatagaccttcaaaacatcatattgagcttaggaattgtcagtatcgtc<br>atcggttttgcatctcaaggacatcgtatccaattctcatctgaatatttgtaattggagataagaacgtccaagttggagaaacatagagat<br>tgacgggagaaaggagccatcacaaaggttggtttagaaatacaacaatgattggtatggataactttaaggtaaccattccaaactctgttc<br>tttcaaccaaaacatataaaaacttcccaatgggaaaaatatgataatatcaataagacaaagaaccagtcatttagctagagaaataatgaagaaggctc<br>aagcaaaagatgacagaggctatggaaatatgataatgattataaggatagagacctgaaaagctgtaatcttagaagaagcaataaactaatttatgact<br>atctcatgatgaaaagaatgcaggcatcttaaggatagtaaataa |
| Contig47_gene_174 | 1274 | atgataagcaaagaacattgataagaacaaggcaaactttaaaggaacaagtttaaaggaaatagacaatcctacacactgcttca<br>aatagataactacatgaattgcagggcattaagcggacaagcattgaatgggacataagcgcctttatcatacacctgcgtgctttgatgttatcctaataggaattcat<br>ttagtctcaaataagttgaactatcatgaactatatcatcttgaatacagggtcttagcagaatcattaaggcttcagttttcctaagctatgcagg<br>agcccaggaaaagttatatagataaataaggatatcctccttgtttatcgagcatggagttccattggttaaagaggtattgggaaccttggatttcactgaat<br>tgcctcaaagagagaagaaatcatcatattcatcacgtgacatatacaccaaatagcaccttcattgtctgcattgaatgtctgaatgttgaattataagaaaagacaagaaaatgaggaca<br>cagaagaatagtcacataaattcatctagcacaatagatgtgaactaaatcagtggatactatggatacaatagcagaatatggaatataagcaaattcatttgaataatctcaaacgcttcaacttcaa<br>ttaaatgatataaattcatctagcatcaaatagcagaagtgttgaactactagttttttaggaagcttattacgaagagatgt<br>ccttaagcgaaaatagatgaccatgaaaagatgttcctgattgaaaacagtactgtatcgtatcgtatcgtatccaaggcaagacagacagaaacagaactgtaagatctttaa<br>ctttcatatgcagctagagagtttcctgattgaaaacagtacttggtatgctgtatcgtatccaaagcaagaccagattgttgtttaa |
| Contig47_gene_179 | 1275 | atgaaatgaatgaaatgttgaaatgattgatacagagacccctaaaaggcaatcaataaacttgctggccttgatagcaagcatgtcttgat<br>ttttaaataacattatagacagtatctgggttgcaggctgcaggcttgggcctgaccctcttgctgcaatcggctatgtcacacctctcttatggtgc |

FIG. 9B-240

| | | |
|---|---|---|
| | | ttgtaggatttgaaacggtatcggtcaggtgcaggtgcaacctcacttatctccgttatatcggagctgaaagaggatgatgcaacaatgcagcg<br>attcactctgccatattaagtgtgtgttgtttcattggttctcactgtcattggtttcactgcctttctatagagtcctgcttaagctaatggtgctgg<br>gtctgtattgaaatatgcaatggactatggtgtgattgattatattttctttcactgcctattgatacctcctatatttgtgtgtcttcaggg<br>ctgaaggagacaattaaacgggcaactgctgcctattgtgcctattgcacttgttgctgtaatcaatatgatttctagatccgatattcatgtattggctgg<br>ggaattcaggtgctgcctttgcaacagtgcttgccatgctgctccatgctcgttcttgcatgatgctctattggaataccgtgataatcattaaaagacacttatct<br>ctcatataatagaaaggattccataatatatgctcagtcaattatattgtataagatatttagttgttgaatacctgcaagcctgagcagtaatcatgg<br>ctgcacttgcagttcagttacagctattggagttgaactgctgccattacagtcacaggtgttgcatatgtgcaagagaaatatgaaaacataaggactcatta<br>ggactcttgccagctattgaagttgaactgctcatatcctctattatagtatgcatattgctctttatattgcagatcaga<br>cagatattcagttaagctagttctcatatcctctattatagtatgcatattgctctttatattgcagatcaga |
| Contig47_gene_181 | 1276 | atgatttattcaactctactgattgcaatgcaactgcaatgatgcttagcgttcctaacaaaggattcaccttaagaacctcac<br>aaaaagccaagcttatgttgaatattcttgttgaatattcttcaggcttaatgcctgttctcggatgcctaggagaatccaacttgaatggc<br>tcattacaaccttgcacctggttgcattcattcatcctcttttaatcggttcaaatatgttagagaagtctctctgtgatgaagaggat<br>gagaagagactctgataagttctaattctaataatgattggagttgtagcattatcttacataattgacttatttagtaaaaaaataggaa<br>actaaagtagatatctctatataaatgtcggtgagtagtcggtgatcttaattctcttcggtgtaaaatactcttgaaggtttgaattttagttta<br>attactttggaacaagtttgagatagtcggtgagtagtcggtgatcttaattctcttcggtgtaaaatactcttgaaggtctggaatttagttta<br>taa |
| Contig47_gene_185 | 1277 | gtgagcagcactaacactgctgttgaaataaacagaagaagctttcttaaaacaacttcaaaccaagttcctaaactgcaac<br>agaaggattaaagcaagaagataaagaataaaaatcctgctacaaatataatgcctaaaagaagaaactgttgatgctaaagctaagg<br>aagctcctaaaagggaagctccctaaaaagaaatccctaaaaaggatccctaaaaagaagttaaaaagaagagctcctaaaagaaattaaacca<br>aatattgttaaaaatcagatgaagttcatctgccgaacaactgatgaagtgatgaactatacagacggcatcatcaattcaccatctctgtaact<br>cgcaggaatcgtataccaatactaccagacaactgcccaatccatcagatgtaaatgacactgtaaatgacactcaaggctattccaagataccctcgatgaaatcaa<br>agcgatgaaatcactcatgaaaaatactttatgaaaaatcctgaaaatcctgataatcaagaggttaatgt<br>gggaggcgtccaacaatgcaaagatataatcatgacactcaaggctactgacatgcatctgacatgcaaaatatcaagaaatcatttaaggaat<br>tcgttgcaaacaatgcaaactgcaaacctgagacactgcaaacctgataccaatcatcaagaaagctaccaagagacagtaccaagacaaacaag<br>caattactaa |
| Contig47_gene_187 | 1278 | ttgattttcagcaatctttgctgttgaatattgctaaggataaaatagtccataaatttctttgtaaatcctcagaatttattgcc<br>tgaagagaaaatacaaacattgaagcaggttctatgtattcattcaattctcaattttagttgtgtatctaaacttcttcttgacaataata<br>tcatattgccaaacagtccgaattctatgtattcaatcctttagatattcattcctatttggcgaatctttaattgaatattggatttgt<br>aaaaaaagcaaaatattcctcaatgtttcattattatttatgaagatatttatgaagatccattaaacgcattggttatgtctccatgcatttaca<br>agcaagggatatacaattttaggtgaaaatagtacactatagcatatttctagtttgggaggttatatatctggagctgctac<br>agctactttgactgctgcaatttaatttaagctaaaatagagaaatttgatgaaaaattagaaagttaatttccg<br>aataa |

FIG. 9B-241

| Contig47_gene_190 | 1279 | ttgtatttagaattttggataatttttagccattatcctcataattggagaactgctgacaggtggattctacctattatccataggactggatc<br>gctagctgctgcaatatttaactatttccaatttagcattccaatttacaatttggcattttatttagttacagtcattttatcattcttttcta<br>ggcctctcttaatcggcttaatagaaacacaattgataaaaaatcaaacacagagcgattgttgattggattgaaggagctatggaagatatt<br>gggcaaaaaatattggagcaataagcataaaaggagaagtctgaaaagcccattcagatgaggatatctaaaggggaagaagtaaaaataat<br>agtatagatggagttaagttaaagttgaaaaactctaa |
| Contig47_gene_191 | 1280 | atggatttaatttacatattaataataattatcattgcataataatcgcatacaaaagatcataagactcatataagacctttatgaaaaaggggttgt<br>agaaagattaggagaagtacaaccgaactgtagaaaggttgtagaaaaggtctgaacattgttattccatttatagacaatcagaaaggttgacttaaggaac<br>agtcgtagatgttcctccctcaagaggtaattacaaaggacaacaccgttgtagttgtagattgcttatcttttgcgagtcatagatgccttc<br>aatgcagtatacaatgttgttaacttctctatcaggcaattaccaagctgcacaaccaatctaagaaatatcatcgtgactggaattggacca<br>aaccctgacttcaagagagatgatcaataacagatgcgtgaaaacatgcctgatgttgcaactgacaaatgggaacaaaagttgtccgtgagaa<br>ttcaaagaataagacctccaagagacatcgttgaagcaatggtaacaatgtgaaagcgaaatgaaaagagctacaattctagagtctgaa<br>ggttatataggaaatctgaaatcaaaaatcagaaattgccattgctgaagtaaggcaagagcaatccaagattcttgcagccaagcgaagcaatccagttc<br>agatgcaaacaaatatcagaaaattgccattgctgaagtaaggcaagggcaaccaactaaatattcttgctactgaagtttcaggaatc<br>atgacctgattgcaatcaagtatctgaggctcttgaaacattgctgaagagagcaacattgttaaggacgatcctgaagcattgaaagatatatcctactata<br>ttaggctcagttggaagaattgttttaaggacgatcctgaagcattgttaaggacgatcctgaagcatatcctgaagttcaaagcttcaggaatc<br>acacagcagataatgaatag |
| Contig47_gene_192 | 1281 | ttgggaggtgaaaaatgcaaaaatgaatgctgtgatattaggattatattgacacttgtgttttacctattcttgaacgctatgaattctg<br>gggtctttaattgtaggattcattgtaggatatatagctcacgaaggaatattaggcggaatgtgaatctgcaatgaccctgcaggagcattcgaa<br>caatcatatcagcaatcctattcattcataatgtcacaattgaggaactgcaatgatggatctcctcggagacttgctgattcacagttca<br>ggaattacaagcttgattgatatttgatattacaataatcaaatatatgattgttatggaataactgtgtctgtaggtgagccttaagcgagaa<br>aaagaataa |
| Contig47_gene_193 | 1282 | atggtagatgcagaaaagcaaaacaacctaaggagagaacaaaacagtaaccttccagatattgattttaaagcattaatttttggtgc<br>agcagcatatgcattttcccgcttgttgcataccaataacatctagacatttaatgtatttgcagcaataggtccattatacataggatata<br>ctgcaaaaactgaactttaaatcaacttaaatcatttttaggaattgtaggtgcaactcaactccactattgtatattagcttttcaggcatgtttttggagatcatacgga<br>tcaggtgaaatggcagatatatcaggggtattgtagtcgaagacactcctaaaaagaaaacaattgaagacactgaagtgtcaaaagaatgttg<br>ctaacttattccttccaaaagcagaaggaaaaaataa |
| Contig47_gene_209 | 1283 | atggccattggagttaaagagattagaatcactgatccataagtgttttattatgccttaatatgcctaatcatggtttggctctttt<br>tttagcaaacctataaaatttatatgagaatagtagctgaaggagcaatcaaggtagctgaaggagcaatgtttttattatggagtttaattgctaaatag<br>ctatttcgagcggacaatccattgatattatttatgcggccctcgattttacaactttgggatttggcactcttatagcattg<br>ccgttgcttgatttaggatttttaggaagacaaggagtttagcatttgttatagacatttgcctgatgtggtcattatcgacaagta<br>tggtttcaaatccctcgagacaaggagtttagcattttgttatagatcattgcatcgcttattactatattagcactgcatgcttacatgacttcctatcagcatat<br>gcatttcgctcatacctgccatgctaccccattgaggcctttgcaggatgcagtacattagcagcattagcagcattgcagcattagcatggtcattggtg<br>catatgtaccctgcagaaaatatgctactctgaggattgtatcccaatgttatcccaatgttataaatgttatctccaatgaagggagaaccattgatgacgaatatgctattgaag<br>ttccctgcctctctgcagaaatatgctactctgaggattgtatcccaatgttatcccaatgttatcccaatgttcacttccaatgatgggcagataatccacaggag<br>gagtaaaaaagataataatatgctactctgaggatttgagttctgtaagattgaaagatgggtcactttcctgcactttctcaatcatcggc |

FIG. 9B-242

| | | |
|---|---|---|
| Contig47_gene_212 | 1284 | acagttgaaatttcataggttatcataccctttgcttgatgtgttcatcggaatgctaatcattcaattattaccctta tcgaatgtgcct<br>tgagaggataattccatggatccatcccatcaatcatttatataagttacttgtattttttagccattcctg<br>atgaagcatagattaaatttagataataaagacccaaattatattttgttgaagaaatattaaaattatggattctagaaatccaaaagtat<br>attagcatcctatgatttaaaaacttaaaatagaacacatatttacttttataagtatgttcttttgaattgacattccattca<br>tttaaacgagcttaaatccaaaaagaacttcgcaaatacttttaaactctgaagtttgactgcagatcaagtttataaaattttcagaa<br>ataaactctgaaaactttataaacttcaaacagaatctcaaggaatatggttaaaagaagagaaaaagactttattgttgatgc<br>gacccagtgacgtagtatattgtttaaaactccagaataaaagacttaaagacatctgaaaaaataatctcaaatgagttattcatcctcta<br>aaggttattatattgatttaagaaactttcaagaagttgtttattagattatgattctatgaatcctgttgtatttttagtccactctgagctcaaacgat<br>gcaaaactttcagaagaatcggaatcagcaaatacaaaactccttaaaaaagacgaataataacaaagaaaaatcagcagaacccgattgatgacattttaa<br>taaaactaccaaatccgtgttaacaataaaagaaataatgaaagaatttacaacagttataaagaagaataatgaaaaatagat<br>ctatccactagccgtgttaaccaataagggcaaatagaactttaaaagaatttttttaggagcactgattatatcacaaggattttact<br>tcatggaaaaatttaaaccaataaggaggcaaatagaaactttaaaatgaatatgagaagagaataatgaaatccacaaatatac<br>tccaaatcagtagaaaaaccgtttatctcaaatgtatttttaggagcactgattatatcacaaggattttact |
| Contig47_gene_219 | 1285 | atgtttgtaatatccttatttgacaattttgttgctaataatccgaattctctttaagcgaatcctatatgttgatttttat<br>tttggtgatattattccattttatgagccgtatctgataaaataatgagaatagcgaatattgtctgagttttgattgaaaatg<br>caataattattccatttcctaattattaggattcattataggtttttaggcactatcctattgcaatcagcattgtctgtttgattacaatc<br>gtaaggtcaatattattccattaaatag |
| Contig47_gene_220 | 1286 | atgaaaatgaaaacttgatggaaccaataggctgaagctttttatgatgcgataattattgtaacagttttggtttgaattgcc<br>acagcctgaaacgctaccattgcaggaatttagctttgaaagtttcatattttcacttcgtcagttttcctgttttgcaatctctgcaa<br>tatcaccacttgatatatgctcatgtgaaaaaattga |
| Contig47_gene_226 | 1287 | atgagcataattgcaattttttctaggaataatagtcattgcattccctcttttaggaattattgcagcatctgatattcttgactatcagtctt<br>attgcttcaatttcttgctcttaaacgaatatctgaagtgaatataacactacaaaaggctttaaatacattattgactgataatgt<br>tgtttgtaagcttaggattgatattcaaccaagcatatttcattcattcaataacctaaccgctataacctttcattctagcaggaatttcttgataatcatt<br>ggattgttgttgattgttgaaacaggagaaataagtataaattctgatggaataattgagaattaatctcttaggtgtaatctatataattcttgg<br>aacttatatccaaattcattgtctcggttcttcatgatttcagcttagcgaataaaactccattaagcattgtcggaatcatctcacaaat |
| Contig47_gene_234 | 1288 | atgaacgccaatccaaaaatactccttcttacattctaatgatttcagccctggaataaacactccattaagcattgtcggaatcatctcacaaat<br>agcagagtattcaatacatcaatagccatttcaggactcctatgtaagctcatttacattaccatagccatatgcggattgttcatcacctgtttt<br>tattttcaaaatacaatgaaaagaaccttgtaagcattttaacagtgttgcaatatcaaacatttgcaatatcttacaaaagcattact<br>attgcctcttttctttagaatattacaaaattctcttagcagcattcatccggattcatatcagtttgcaagaataacaaggacaaagatattcaatt<br>agacaagatttatattacaaaattctgttttgaatatcaatcgtgaagcattgtaggcctcctataactttcccaaaaatcaaaggacaatattcaatt<br>atcaagttgcaatgccatttccagtctcgcaggtagtcagtaatagcaaaagacaaagcaacgatgcttctaataatggaataggctaaaagt<br>tatgaaatgcaatttccagtctcgcaggtagtcaaaagacaaagcaacgatgcttctaataattccattaatatgtggactgtttgtactccttatcta<br>ttaccagccatactcctgcaggtagtaatagcaaaagacaaagcaaccattctcattttccattttggatcttagacgaatgggctacaatctcatccaatctcatccaatattggaa<br>cttggcttgaggaagttataatagctaaataattgattctaatattgattctaatattgattctaatattggaatctgaatggaataggctaaaagtc<br>tttgcaaattatctgtcaagcttgcaaacggagtgttttttaaatgagtgttttttaaatgaggaatagctcttggaa<br>agtaatcccagacgcccgagcttgcaaacggagtgttttttaaatgagtgttttttaaatgaggaatagctcttggaa |

FIG. 9B-243

| | | |
|---|---|---|
| Contig47_gene_235 | 1289 | atgaatataaatggtgatttgatgaataaaaattactgtagacatattaatgttcatagcaatagtgaatttctaagcctgcctattct<br>aattcatgaaatagttggagttgggatttattgttttcataaacatagattgcttacacttaaaatataacaaaagtattttaaaacaatagcaaaggaaaat<br>ataacctaaaagaactctaaatcttatcataaacataggattgcttgttccttattgataacccatattttcaggaatctcttctagccaaaag<br>tcattaaaaggcatgaagataggaaatcacaaatttcacatattcataaatcatcttcatattagtctaa |
| Contig47_gene_246 | 1290 | atggtcctgattttataatatccatttcaaagggtgaagctgaatcattaaacacttcaatgaacatattcttcaccgatctgattattattgc<br>attcattcctttcattgtatattcctgtaatattgtatataatatattggacaggcccttcctcctattcatcttcacgaggggatgaactcagactct<br>actttaaggcattgcaatcctgtaatattgtatataatatattggggcagaatctcatttaggatcagaaggcacatctcattctca<br>atagcctttcttgctgtgtcttgattccgtgcctctcaatgtattgcagaggaatatatattcgtggattatcatgcaaacattaggtc<br>atggattggataccctcttatagccatagttatcaagccataatgggataaacaaatggcatgatatgacgccctagaactccttgaacattgg<br>tttaggtattgcttgactggaagcatcaaattcctctttcgtgaaaacaaatgcagatagagagaatgtcagccctcatactgcgaataattttctcttgctta<br>ttcatcatgctgtgactggaagaaactgattggttgtgtgaaatcccagagactctcaaaatataggattattaaattttaa<br>gtattatgttggcaagaaaactgattggttgtgtgaaatcccagagactctcaaaatataggattattaaattttaa |
| Contig47_gene_248 | 1291 | atggcaggacttatctctgaattgttgtttgctttgttcttcacctcttgctctaggtgtctctgaacagtcatagggtctgttttcagctcattcttta<br>tcaattcctttcatcctactctgctgagaagtatgagagcgagttgggaaggaacttcaagaaagcctagaaacattgcagcgaaatagtct<br>atatattccaatggtcatagtatagaagtgatctttcatcctctgacatgcattatgtatttgataagatcttgacattcttgag<br>tatgggatattccagaacaatctatttaggttaatggtcttgttctcttcatcagagaatggtggatataataagtgacttgaccagtcatgtcataacatgt<br>gatcaatgtgaaatcgtttagttgcaggaatatatctcagagatggtggatataatagtgacttgaccgtcagtgcataacatgt<br>tctttgctgatttgactttttatgcaggagattatgatgcagtgaatgatcgcagagtataaagagcattaatattatccaagccagatcaggtacctacactagtctctaaccctg<br>attccaatatgatgattatcataatgatgattccataataaagaaaagatcctaaaaagagtcaatcctgattctcatgtatcaggaggattatttactc<br>tataattgatgatgccaaaaaacgacaagtcattaa |
| Contig47_gene_250 | 1292 | atgaaaaaaccaggatttaaataaaaattacaattttgacattctaataataatttgatcattggagcagtggattcgcagtttaccatat<br>ggttgatgactcaacaaagcttcagctacctcccttgactattcaacaaacaataagatgcttgaacatatatgattattataaagatg<br>gaaaatagtacaagcagccttattgaactaaatcaaacaccggcaagcctatactgcgttttctacaaagacacaccccaaatgaagtgcacagtcctgctggagacaatcaa<br>aacgataagtaaacattgaaattaacaatgaagacagctatgcaaacattacagactttgtagtcagtgacctagtagctgcttactgcttaagaagattccaagaagagttaagacaatgattaagaaatatatcta<br>gataagcctagaacaaatgagagacaatgagacagctatgcaaacattacagactttgtagtcagtgacctagtagctgcttactgctcaaaaattagcaaatgcattaaat<br>aaaaataagaaaccttgcattgtcttaaggacagacaagcgagatacaaattagaatctataattctacagcacaagattccatagacattcaaaatgcatttacaa<br>tgtattaggagactttaaaggacagacaagcgagatacaaattagaatctataattctacagcacaagattccatagacattcaaaatgcatttataa<br>atgttttaagcattgctaatacaagtcattaa |
| Contig47_gene_251 | 1293 | ttggaattattgaaaatcaatgggtcaacagttattttaaggcttatacctagcgaaagattcctatcaattgtaaataagagtaagatctt<br>aaggaagagatatttcaccccttattgttttagtcacattcactctttttatacttcttgcaactgatccggtcccaaggatttgcagacca<br>ctataatcattgcttttctaagcttttttattggtcaataatatttccagatttattttgaataatcaattaaatcattaatgatgaaact<br>aatacgacaataaataaagaatcaaagactgataaaagcaagcaaattccctattaattccctacgatgtatattcaataggattctgccttagctt |

FIG. 9B-244

| | | |
|---|---|---|
| | | aattgaattgtctttttgtttttaagcattgcctccgttgctcgttgagggctgccaatactactaaagtcctcattaagatattcacttaagcagcattta
caatgcctgtattttaataattccagtatgcttcacattatccaacagtacaagaataatcagccgcagccaaaca
agattcagattcttgttttaactgcaattgaactgtcettacactccaatatagaaccccaatcattgcatttacttatgatgat
tataataggatattatgtaaaatactatcagtttggaggtcatttagtgccctggagtgctgagtatgtgccatcattgaattggatatttaa
gatcattgaatgacttgcaataagctcaaataagctacaaatatatttccacttaaactcaaggcaaacttacaagctgcttattgaacctactg
aattatattcaggaattcgagactaatgcatgaaaagatgatgaaaatagcaagccatgcctgaagcgctcttgacctagaatgatgtgggcaa
actgatagcttgagaacagaggttactgttaacccctacattgctaaggacagatgctagtgattcggaaaac |
| Contig47_
gene_252 | 1294 | atggcaatagaagaagttagaaatttggaagtgatcgcttctaaggacactcattcataattgaagttaaggtaggttaagcttattgccatctt
attaataatgtttctgtgttttttcagatagctaattagttccactttgtatttgaaatattctgtcattgaaatattctgtcgctgaattgt
cctttaagacagcttaaaagaatagctctcttttgccattcgtggttttgttatacagacactgttttaaattgacagttctcttatttgctagatta
tggcaagtcctatcctacctctcacctacctacaatgcaggaagttgtcatcattgagaaagcttgaatgccaagagatctgctatgatttaacaatta
tgtcatccttcatctctcctattttatctttgtagatgaatttaagggacatcagacagtcaatgaagtctagaaaacttgatccttcaataagaagattccg
tggtcagattcctattcctattctttgtagatgaatataggacatcagacagtgttttaaagcatatgaaaggagaaaccattatttaatgtatgccag
cagatgcttctcagacaattccagatttatcatgccaagacttgaaagcatgagaagcatgatgagtatatttttagcttgtgttataggcattgtca
ttgttttagaactggttgtattgttctattctggcaattgtgattattaaggcgtttctttatctttataa |
| Contig47_
gene_254 | 1295 | ttgattatgcattgtatttcgctgaaatggccaagcaaatctagatgggccaagcaaatctagatgaaaacgtataccactcttcgattagctgcaggtatttt
tgcaattatgtctctatgaacatgcctattccatttgttaccagtggccacatggtcgtgggcattagtgctatttgtgctatttgctcctgaag
ctgctgttctgttctgtattcactgcagtatgctacagactttattctctcgagacggtgaattaccgctttaggtcaaatgtattaacatg
gctatcgttggagaggtgtgtggttctcgtgttgtctgtctttgagactgctatgcaggaataaacggcatcatttgaaaatatcctcaatatccttaggcgcatggcttgc
aacattagttgcagctgtttgtctgtttgaaggagtattaacagttatgtttatatcgtgggtcgttctatgcacttttaccatg
cattcattgttttaattgaaggagtattaacagttatgtgtatatcgtgggtcgttctatgcagatctatggcatgaatagaataag |
| Contig47_
gene_256 | 1296 | atggcaaatctcaaaataggtttagcaggtaatcctaatgtaggtaaaccaccctattcaataatttgacggtttaaacaacatgtaggtaa
ctggcctggtaaaccgtagcacaagcaaaaggttcctataaacatagtgggaacgaagttgaagtaattgattaacatgttgctgtaactgctttaa
gtgctcattcaattggtatcaagaaatgtatcaagagactttatcaagagacttatcgagcttaattgtatgaataagtacgcccaagacaaggagatatac
aagaaactgtatctgactgttcagatgatggagctcggagctcggagtcaattattggagttcctgttgtttgaattgaagcaatagtgatagctaaaaacta
atcaatgcagataagctcttcgactagctcgcaaaccgtagaacccgtagaacccgtagacctcttctaaaaattggtttatacaatgaaactaaaagaacttcctgaattgcagctgttata
ttgaacaagcagcaaaaacttacttgtctgttcctcatcttgattcaatcaaattgcttgaaaatgatgaaatcgttgaagagaagttgaaggatc
gaagagacaaaaacaatatagtaaatgaaatcaagaaactcaagaaactcaagaaacctcaacaagccgaccattgaaaaccactactaagtgaaacctaataagatcgcaaatg
ttcaaaagaacaatatagtaaatgaaatcaagaaactcaagaaactcaacaagccgaccattgaaaaccactactaagtgaaacctaataagatcgcaaatg
caagatatgcattcattgacggattattaaagaactaagattaccctctccaccaagccgaccatttgaaatcgtatttacttcgccacccttccaagatttgat
acaaacagatatttcttgaatcttaggtgatgcatatgccataatcgctccctgagaaacaatgctttcttcattcctag
tgacgaattctttgaatcttaggtgatgcatatgccataatcgctccctgagaaacaatgctttcttcattcctag |
| Contig47_
gene_258 | 1297 | atggtagacagacatgaaattgtagacaaaatgtatgaaaacacactttactttcgtaggagaattgcaactgcaattgtagggcaaa
aattttaaaatcccaaaccactaaagattacgctcaaaagaaaggaatgctaaagttctaacttgcaaaagcgacttagaaagaatcattcaagaca
ttaaagacaatgcagaagacattcaaactgatgcaaaagcagctgctcaaaagagcaatctgtgtagatgtaactgtgaagaagaataa |

FIG. 9B-245

| | | |
|---|---|---|
| Contig47_gene_265 | 1298 | atgaataatcaagattacgatactggaataagttcagaggttttacagtcaatcaaatcaaatcaaattaatagatatttttaattgattttaga aagaaagcaaggctgttatgacttattgatgtctaacaaacaagaaacaatacataagtttccatcataattattgaacctatt tacaggaatagccattgcgaaatatttttatcataatggtttaaaaatattactatagttgatatttatcccattgaaggttttattgat tctaacttgggagatcctattgatgtgaataatcttctaaagtaaatttaaagagaatagaatttcatcagatttggcttaataagaag tgctgatgttgtaattgacactacttga |
| Contig47_gene_271 | 1299 | atgttttatatattgtttgcttttgtttatccttttatctttcctaaataagacatgagaatgatgattattcatcaatctcaaaagaactgcctatgc attgcgccaattgtccactgaattaagggctgaaaaagcttgttgatgctcttgattcatttgtgactctgactatggtgttttatcaaggg aatttccaaggttcttgaggagataaaatatggtgaaacaagtgaaaatgcctttttgaatctggagagaggtaaactccaaggcattatct agagtaatctatgagatacttgcaagctttaaggatagcaagcttaaaaattaaatcatatttgtgaagatgttaatttttgatat gagaatgaagttaaaggaatatagtgaaaatttaaatgcttcattatggagcgcctgtgatttattttaacaa tgctcttgcagcttctgttgtattggatattggtcaagctctgtttcttcagtaattgtttctttcaatgataattgtttt ttagcatttgcaattaagaaattagagcctaagctgtga |
| Contig47_gene_275 | 1300 | atgtttgatctattagcggcatgttttattggaatagcaattggaacaggtacaggtccaggcatccatgtaaaacactgccgagcaat catgtttgcatcatcagattttgctcattttctctcctgaattttatgtatcaatgagtatttgctcacgcttgattg agtttgttccatcaatgcttcttcttggagttcccgaagagggcactgcaagttctctattcttccagacataggatgttttgaaggaagatctaag gaagctatcagaatagttccttacagtaggcgggtttgcgctatttgtgccaatatttgcagtggcattgccattctctgca ggattatcaagcctttacacttgagtgatactttaaggtttgtcaattttagtgatatcttcaggaaattttcattaatgtgcactttcagtggt ctatctgttatttgtattatctggagcaactatctttttagctttaaatgatgcactactttaggcttcttagcgtaagaaatgactacgattctgtaaggataac aataagagcattttcgcaggagatgggatgcaactggaactacctttagctttaccaggttttgaccagtgaataaagccagtcaagaagaactatcagaaaatacagacttaactactcagagaaccatccttatttttcctaatagca tatgtggaacaagcagatgggatagaaatcctagaaagtgcagtgtatgctgcagtgatagatcctgatattttcctaatgca atctatctgataaaatatcatatcagtttcaatattgcttaaagctggagacggctttcaaacctaatgc tgctcttttcagtttcagttttatttgcgctttctcaaacctttataactcaattaggattaggagccccacaataggatttattatacgtttttgcct |
| Contig47_gene_281 | 1301 | gtgacaacaatattttatttgcgctttctcaaacctttataactcaattaggattaggagccccacaataggattatattacgttttttgcct attatttggccctttgcattatgttgagttttctcttttgcattgcatataatcatcaaacgtagcaatagatgtttatcatcaaacatactccctcag ccatcatcagctttgagttttctcttttgcattgcatataacgtttggtactccggatttaaatcagatcagtagtataacaagattgatacaatt taccacctatgcctatttttagcaagcataatcattccatcctctcttgaactttacaaacgttgcattcattgatgttattggtcaggaattggctttttaaagagaacaa tatagagaatcaataatcattccatcctctcttgaactttacaaacgttgcattcattgatgttattggtcaggaattggctttttaaagagaacaa atctcatagagaaccctaaaaatcagagcgtcgattgaacaagaacctatacgttgatctttttccttattaatgtcatgacaatagtctca ttcatattcataatgagaaattcagataatctcacaataatcacaggccataataatgtcgcaattgtgccctaatgtatgcctatatgacaaagccatt catacatgagatacaagaggtcaacagagcatattgtcaaagattgtccgcaattcattaattcaccctccaatcctgatttatcatccctgtcgatccttcttgtgataagcgacata ggctcgttccatagccagcttgactatgttgaaaacaagcattacactcaacatggagataataatggagataatggagataatgtcaagcaatcacctcatttccgaaatctcattttccgaaatgtcaatgaacaga atcatcaaggaagatgaaaagtgaaaagtagaagcggaaggctcattaagtctattcagaatatgtcaatgaacaga |
| Contig47_gene_284 | 1302 | atgagcaagaatagaattgaatgattgatctcgtaagagctcctctatcattcatgcaacagatgaatctatattat ctccctctgattttaatcccctattggactcctttttcaagagttttcaattcatatcactttttattggacgtataggagttccattcttctttaa |

FIG. 9B-246

| | | |
|---|---|---|
| | | tgattacagttatctattgcttgatagaacctatgacgatgagagagtcaaaaagttttgaacaagagctgtaaggcttggtcatagttaca<br>atcatctggtccctgattatgcagtgagcacagcttgtgcctattcaagtcaatacaagtcaatacaagaagctgaaacctattcttcag<br>ccatatgtggtatatgccaatgattatcggtatttatccatgccttcgtagcgaatgcattgagcaaggcttgaaaactttgatccaagaacaattaacc<br>aagctacaacatcgtattctctgcctgcctgcattcctgctgcctttcattcgattgtatgtagatgcaaggcttcagaatgtaaacatccaatac<br>tgcctggttcagtggagagtatatgtatctatatcattggctgctgtctcttccaagtatttcaggactattcctcaaacagctt<br>gaggcgtctgaatagttcgtttatatgttcgttctcttccatggtcattctcttacatagacttcagttctcattagtgatgagttcc<br>cattatcctaaccgatcatttgcatttgaattatgtcaagaagagaaagttcagaggattaagagaattagagttgaattttagccaaatat<br>tcatttgctgtgtttttaatacacaaccgttagaatcatatgtcttcctagtgtgttacctgccatacagaacggttaaagcgattat<br>actttgatactttaataataaccagttatgcagctgcagtttattcttattataagaattcctaagttcgtaaat |
| Contig47_<br>gene_286 | 1303 | atgaattattattatcaaaattatgccactgtcttatgggcaatgacttttattgatatgccgctttaatcataatgattttcatatttgg<br>atatgatcagtcataacaagatgtgataagaggggcaagaaactgcctaaatatacattaaagagtgcaccatctatgaattaaatgtg<br>ttatagtgcactcatatatctgcagttcaaacctagttagttgttgacctttccagaattccctttccagaatttgaattagagcatgcc<br>cttacagataaactggaacattacacaaatgtcactgcaaatacctattgattggcgaatatgttgtaatagtataataattaacctatat<br>ttttgtgttctcttatgaaaatttcactgcaagacttgcagatgggaaaattgcttgaatcattaatttgctgcaatcaaacgatcatag<br>acactataggctgaaaaaatatacagatttgatttttgcctctagtcttcaataatccaattcattggaattggcaaatctataagatatataaat<br>ggattcttcgattacataacagatttgatttttgcctctagtcttcaataatccaattcattggaattggcaaatctataagatatataaat<br>taaaaatatagcaatctgataggccgacaaaaaagagtgttaa |
| Contig47_<br>gene_287 | 1304 | ttgttgcttgaactaataattgaaaacttactagaaaccattgcaagcatcatagttttctaattccattaggaatagaaaatacattatgaa<br>taaataaaaagcatgaaagtaaaattacaaacaatagctacttcataatcccgctgaatatatgccaaaagaagaaggttgaaacattaaagcaag<br>tatcctattttaatagtgctattttactctcatattcttcatacagttttggcaaatatgcaaatatgaaattctctcattttagaaatt<br>gtattgatgtatacattgcattgaactttgattaaacaagtactgttttttctttttagtgcctattgtgatcaatagcatg<br>gttccttttttgaagaaacaagatactgttttggaactgctagttcttcctttccagttattctcatattggcctatctttatgcctattgtgatcaatagcatg<br>aatatactgaaacaaatgttlaggaataaccalallgctaltallyctgalaaltalllallagltlatttaacaalgattgtagaaggagtc<br>tcaccgatcgattcaatagcaatggtctcaatatgccaatagtaatgcattacaagtagattgatcagtttaggaagttcattggtggaaattaaacagcat<br>actattggtttgagcggttatatctccttcaggagtaggtactgctacaatgacaatgaccgaattaaaagaatgattgaaagaaaataatgaggaaattaaagagatccttaaagagaacaat<br>aaatgaaaaacaaatgaagaagcacaatgaattagaaaagaaaattatagaaccgtaa |
| Contig47_<br>gene_294 | 1305 | atgcttgaagttttaagaccattcttcacaaaaatattagaacctagccagccgattaaatataatccaaatattgtaactataatttcgcc<br>atttttagctatatatctgcatatttcttgctacaggaatttgattggcggagcattcttcatacttcttagcggattttagatgttgttg<br>atggagctgtagcaagatacccacacagatcaagccacatttggtgcattcttagactctacaatgacagattggcaatcatcatcatt<br>ggaataatctttggaggttattgtaatgactgatgggtttgagttttagcaatcatcagcaatcatccaatggagattgatagcaatggatgatgcaaggcaaggcaagccgaatc<br>acaaggagttgagtgcaatacttgaatagccgaacgtcagttagatagcaatcatcagtgatgattagagctgggaggtcattattcttcatcatattcag<br>atataattttcacatactttatctcatcacactttgtagttcttcatactttacagtaggcaaagagtttaccacgtcgatgaaagctaattcaattcag<br>aagaaatcccacacaaaagaagattgtag |
| Contig47_<br>gene_298 | 1306 | atgagttttgtccaaattgtggagtggaacgaaaagaaggagtcattttttgccatcattgtgctatgattatagagaagctaattcatctgg<br>gatgggctctagttctgattcacaagttcacaagtcctagttttaattctcaagtaaatcaaagtttattctacttataatgtccaacaa |

FIG. 9B-247

| | | |
|---|---|---|
| Contig47_gene_300 | 1307 | agcaaatcctcataatttgctaagatcactggttatatattgtccttttaatacctgtattgcaatcgtaattggtatatattgatttta<br>tctaaaatgaggaagttcataaacatggaataattattatcggaattttctatagttgttcaaatacttctatgattttttatgatgggttaa |
| Contig47_gene_301 | 1308 | gtgattacagtgattgtccttgagatttgctgtagatgatcctgtagatgattttgctgtataaaattggaatttattgttatgcagt<br>aagtttatcgtttgctttcctatctttaacttcttaatcctattgttagcatgtaaacataaggttatctgtcaataggca<br>ttgcaatgttttttcctatctttttgacaattttttactataaatgcttaaagaattcggataaggcaaatattgctcttcagatagcattggcagataa<br>tttataatcgttgctatttttgtaccaatcgtatttgtattgttgaatgatcgtgttggctattttatttcccattggctattgtgatgcatgcttgttttt<br>caataattactctatgtgttaatttctattataaaagcatgctaa |
| Contig47_gene_302 | 1309 | atgaacactaacagatttgaaacatttttttgatgcgattatagcaatcataatcacagtctgtattaaagttatcacagcctcagctcctac<br>cgttcctgcattttagcctaaatgcaaggttttataactatgcaatctgttattggccctttttatcattggtatgtaataatcataatttat<br>tccagtagttgaagagataaaataactgtattgattatttatgccatccagatgtttgcaatttctcttctctatttgctacttgggtg<br>gcattgaattgaattcaaatgtctgctgagacaatgtttggaatcgattttctgcaatactattcttttatgtatttgctattgtctatttatgcggttta<br>tagggctgacccctataagttgcggaatatccaaaacaattcagaaagatctattgctatattccgattataatcgttctattaggatttttta<br>ataagctatacagtttatactccaagatttgtctgcattctgattgcactgatttgctgctttttctttttcaagacttcaaagactga |
| Contig47_gene_307 | 1310 | atgagggattgtagcaattgcaatggaatctgcctttgcctttaatcaacacctatctttttcatacccatttcagaattgggagttcctgtggccaattctc<br>tgaattgattttcagcaggattttttcaatgatcctaaaattatgcagatatgaaattttcatacggttatctgaattggccattctc<br>cttatcctttttaatgaatctgctttttattctaattgaacattactctttattaggttattttgctaagttttaggatttttattataaaatat<br>aaattaatcattccatttgccgtcatttcattcagccctggagtgataaattgtgtggcttttatcatgctgaaatccatgtgactgctatca<br>tagttaggcgctgtgttatggctatcctggtgatgtgatcctgttcaagagctatggctgaatttgaaagctatcagaaaatca<br>ctttatattggaattatctggaattttatgactggtgtttattgtctaacctatatgtcttttgaaagattatctgtt<br>tatacctttaataatctgaattttatgactggtgttttatttgtataaaatagttaa |
| Contig47_gene_310 | 1311 | atgaaatgtccgttgtgctgtgagaatccagatgctgagaatcaatttgtcatgatttgtggaatccttgataatgcctgattatgatgaaat<br>gaataatgattaccccctatggattatatgcctgtaagcttatcatcaatgttatataatcgctatcctattcggttgggaacttttatattaagtg<br>ccatatttggatcctatgcaattatgattatcgggtcattgctaaatactatgccttcttttcgacccttttagtctatttagataa |
| Contig47_gene_316 | 1312 | atgatatgtcctgagtgtggtgtgcggaaatcaagactctgcaagtttgcaagcaatgtgaacttcttaaatcctgtgccacaatgaaaa<br>aactaattctgatgaatcaagacctatcaagtcaggtatattttaatgaaataatcttcacctccctcttgaagccaaaggatcaggtgag<br>acaataaaaatctaattatatcttgcttaactgcttaatttcaatattgtctgtttgatagcaggaggcttaatattcctatcaacctacaccgaacc<br>ggaaatgactctagtgatgtggaattccataagtcttccagatatgaaacagatgagttaatcaaacagatgatgtctctaagcagaaccggaagctctctgacttgaaacctggtgttccgttt<br>tgctccctaaaagctctaaaaagttcaagatatctgagcgagaagcttatacagcgtttatacgatgactctcaggtagaccgtgatggctctgactgatccagatcatgtttagtaaccatttatgatgacaatgg<br>aatgttggttcagatgggctgtactggtagcggttccaagtgcattaagtatttatccagatcatgtttagtaaccatttatgatagcaatgg<br>taatgttttagacactccagaggttatcatgagtgctaaaagtggtactcagacatttaa |
| Contig47_gene_316 | 1313 | ttctaaagttacagctattggtatagctattggtaattgttctattgttctattcggccaattattaggattataa<br>ttgggaaacgaggaggatatatgggtaatctatatgaacagtccgagagggactcctgagctgttgggatagttccttttattcttatcagtct |

| | | |
|---|---|---|
| Contig47_gene_366 | 1317 | cttatttactagccgtatttaacaaaacaaagagaataaagattatacaatagtttaaaatgaattaatgaaaaatagat<br>tcatggaaaaatttaaccaataaagggcaaaatagaagattttttcaaattattaaaacaaggcttgaatatgaaatccacaaatatac<br>tccaaatcagtagaaaaaaccgtttatctaaatgttatttttggagcactgattatatcacaaggatttact |
| Contig47_gene_371 | 1318 | atgttgtggacagatttattgtttttgcgattgttatattgtttgcaattttatactgtcgagaagtctgaaagagcaggccaga<br>ggtcccgtaagtttttacatattgtaggtagtaatatgatatttgcatgccattctctcagatcctgatatatgctttattcattacct<br>tgcctgtaactgtgcactattcttcctacagatactcccctattcagattgaaaacagcgttaccgaatccgacgcattagactcctc<br>tttatgcattgattggtccatatttgtctcttgtctcttgttgagaaaatgggtacaatcaaatatcatgtatttggaggagaaaactgttgtaggttccc<br>ggtatatgtgacggatttgctgctcttgttgagaaaatgggtacaatcaaatatcatgtatttggaggagaaaactgttgtaggttccc<br>ttgcaatgctttctgtaactcagcagttgcaacattgtgtgaagctcgttgtacagatacacctcttcagagcttaattatgtat<br>atattgcttatatcagcagttgcaacattgtgtgaagctctcagttgtgtgacaacctactgttcctgctgtaactctcgttttgta<br>ttatattgttgcgaccgtcctctaa |
| | 1319 | atgaatataaaagagttatttatagaatccctaaaagacaataagaaactaataatagaactacatgcatttttataatagtttcattgcagc<br>ttggattataaccgtccgaactgtccaggcattacatacaccttgcatcaaatgaactaactgtaactgcaagcaatgaatgaattttgaacttt<br>tcatccataacgaacttggagaatcaatcattcatcattcatttcttgagaatcttataccaatgaatactgcaaattgtattaaagaattac<br>ttaggagcattggacaattattcaatcattcatttcctgccaaatgagaatcttcattatactaattacctaatcccccatgaatatttgaaattac<br>tgcaacagtcctcagttcgcagctggaatactattgttcctattcatttgaggttcataaggcatttagaagcaaggatacaaatgggcct<br>ctgacgcattgagatgactaaaagacactgattcagacatagtgctaatgttattgcaacaatcctcttactattgccgctccaatcgaa<br>gcatattttctcaactgcatttctcagaattttattatgggttttaggacttagataa |
| Contig47_gene_385 | 1319 | atgaaatatctttttactctttggaggattggaggatgcttctgctttactcactattttattcggtatattgaatatggttccatgtt<br>ctttgaggaaagaagtcaaggcctattacaaggcttctacaaggattttggatatgtctctcttttacttatttgtcatat<br>tgattatctatcggaggagtctatattggccgttttatattagtcattcttctgtcttccattattgacagtctattcctat<br>ttccatgacataagatcattattcatgaaagaacatcatttctgataattaatgaggatcaacattgcccacttctgacgttcattt<br>cggctcaacaaggcatgataagatcattgagagagagcttccagattatgtgactgcaattatcagtggagaca<br>ttgttgatggtcctctgctattgaagagagatgattttctacctcttaaggtgcaagcatattgttctagacgatgagggaatgaattcggcaatcttaatatatt<br>tatctggatattggaggacgtcttggggcatgcaagccgcaagtttgaagagttgcagcacagtgtattaggggattcgttaaggagataagg<br>tgaatattacattcatttctacctactcctaaaactggaggacttctatttggtataacagaggctcttttaagctaatttgacattcaatgtctgccatactcatgaggccag<br>ttccatccacttacttgtaggctcatgattatcctttagatggggtactgactgattcagagatgtttgttcttcaaaattaagaa |
| Contig47_gene_388 | 1320 | atgatcttaaatcttatttaattactaatcgcttaattatactgcctaatttcaataatcctataatgtttaagaataattctaactgttga<br>aaggaaaaagcaggaagcagatacaaattaagataactctgcttaaaatccctatttttacaaaagatagctctgaagacaaggctacagaat<br>ccgaagaggaaaagaaagaagaagatggagaggagaaatatctaaagagaagaaataatatctaaaagccctgatgaaaaatacaatgaaaatacaatcaactctaaaa<br>gagctaattaaatcaaagaagaaattaaagacattctaaagagacattctaaagaaccttgataggacacttgatactagg<br>cctaagcgactctttcaccacagcatcaagaatgcaagtatctaagggacagtttgatactcagggaaaaaaagcagttccattcaagattcattaactgtag<br>atcctagatttacagagatcactgatttgaaggacaattgaattaaagataaatctactgaaaataaattaagaaaaatgaagataaaatgaagaaaatgaagaagacaattccaatgaagaa |

FIG. 9B-250

| | | |
|---|---|---|
| | | attatataaaaaagaaaaagacactgaaattaaagaaaactccaaagaagaattatataaaaaagaaaaagacactgaaattaaagaaaactcca<br>aagaagaattagataaaaaagaaaaagacactgaaattaaagaaaactccaaagaagaattagataaaaaagaagaaaaagaaacttaa |
| Contig47_ gene_393 | 1321 | atggatgatgaaactaataacaatcaatggaacagttcaacaagcttcatacttgtcatggtaggatccatcatagcattggcagggatttggag<br>attttcctatcttatttatgaaaacggaggggcagcttcctaatcccatacatattagccatcgttatcatggtcatccccctcttgtccttg<br>agtttggagtgggattcaaatacaaggcaagcctgccaaggatatttacaatatcaagtctgaatttgaaatagtggcatggtttatccttttc<br>ctaatattcatagtcctaatctgctatacttgcataatgtcctgggaccttatctacatagtcctaagtttatttaaaggatggggcaataatcc<br>tagtgttttctttacaaccaccctacttcatagcacctctaatccatatggcttaacttaccttgtagttcctattggaatcggcctcatattaa<br>tctgggccttgatatatttcatatctcgaagggaaataaataggggaatatcattagtgacaaaattttccctggcattgacatttgttctcgtc<br>atcatcctttcagtctttgcccttcaattgccaggatccagaactggccttatggccttgttcaatccaaattgggaatatctcttggactataa<br>catttggctcactgcattcggacagcttatattttcctatggccttgcatatggaatcgcaagcacatattcctcctatcttccagaggacagca<br>agcttatagacagcgcatgggttattgttctaatcagcctaatattcgaaattctgatgtctgttctcatatttgcattgcttggacatatggca<br>ttgggaaagaacatgcctattacaagccttgtaagcgacagcttctcattgatatttgtggttttccctaatgtattcaatgtgatgggctcatg<br>ggcaacaataataggtccattgttctttatggttatatttataggggggattaggtgcattatttgctcttatag |
| Contig47_ gene_394 | 1322 | atggcaaacagtaatcagtctgaatgggatagtaacattgcatttatttggcaatgattggttctgcagttggtttaggaaatatttggcgttt<br>tccaaatgttctatactcccacggtggaggatcattcatgattccttatatcgtatccctattccttttaggaatatcatttgtacttgtggaat<br>atgctgtaggatacagattcaagtcctccctaatcaaggttctatattctgtcaaaagcaaattggagcctgtagcctggtttatcgccctaatc<br>gtctttctcataacaacatattacatatgtgtagtgggatgggacttgatatatgtggtcttaagctttacaaaggcatggggctcaaatccaga<br>ccttttcttctcaagcattgtccttcaatcaacagattccattgaagggcttctccatattgttcctatggtatttatatccgtacttgcattat<br>gggctgttgcatggtacattattcaaaaggacttaaatgacggcataggtaaggtaagtaagttactgcttcctttgcttttgattattgttgtt<br>acaatcgttttgttctcactgaccttgcctggagcttcaataggctatacccaaatttttactcctgattggagtgccctaactgacttgaatgt<br>ttggcttgctgcctttggacagatcgtattctcccttagcttaggaatgtccattgcacttacatatgcaagctaccttcctgaaggctctaaat<br>taacagacaatgctttaatcgttgcattttcaaattctggatttgaaatcttcaattcaatcggaatattctcaatacttggttttatgacctta<br>aacacaggcattccatttgaccaactggttactgaaggaacaggcttggcatttgttgttttccctaaggtattcaatataatgggtccttgggc<br>tacaatcatcggtccgctcttcttcctatgcattctctttgctggtgtaacctctgtaatggcattgcttgagg |
| Contig47_ gene_395 | 1323 | atgaatttagacagtaacgttaaaaccggattgattgtagctatttctataatttcctttttgttttatcattgtttattactagtgcaccaac<br>aggagtggataattctgctcgtttcggaattttgacactgcttcctcctcttatagcgattgctttagcatttattactaaagaaactattctat<br>cactattcgttggagttttcgttggtgaattcatggtttcagtaagtgatttaaacatcatcagctctgcagttaatgcatttttagctatgggt<br>ggtcaaatcatctcatgtatggctgatccatggaacgctggtattgtcctccaatgtctgctcattggtggtgtaatccaattaattacaaaaat<br>gggaggagcaaaagcgttagctgatgctttggctaaacgtgctgacactcctagaaaagctcaacttattactgaatttttaggattatgtgtat<br>tctttgatgactatgctaactccttgattgtaggtcctatcatgagacctgttatggacaagcttaaggtttcaagggaaaaattagcatttgta<br>gtagacgcaactgcagctccagttgcaggtattgctattatttccacttggatcggtcttgaaatcagtttgattactcaaggtttcgaatcaat<br>cggcatgaatgtaagcggattcggaatattccttcagaccattccattcaggttctataacattttaatcttgattttcattgttatctctgcag<br>ttaccctgtatgagttcggtccaatgaaagaggcagagaaaagggctcgtgcaagaaaagctgatgaacctgttaaatctcttgaagcaaccagc<br>tttgatgatgtaaaacctgtcgaaggcattaaattatccgtatggaatgctatcattcctattgcagtcttaattatcggcgctcttatagcatt<br>ctactggagtggttacactaccatcttaggcggtgaagaccaagcgctcattcatttaatgaaaacttctccat |
| Contig47_ | 1324 | atggaaaaacaacaagtaaaaacaattttaaaatctgtggttatcatagctatattgcttattattgtttttggtcttagggctcaatctgtaga |

FIG. 9B-251

| | | |
|---|---|---|
| gene_408 | | tattggaggagttcctaatgaacttaaatcacactatgtagacgaaaacgtctctcctattcagtgaaatgaactcatacttcaactacagga<br>tgaccgagaattatatgatcatgatactttggtgacactaagtaaacgtaaacggttggatatgcattcatacttccctcagtagggca<br>gtaggtgattatcaaccgatgattgcttatgtgactcgttcctatcctactacatattcacaagaaggattacaacgactatgagcaattgcagcctcat<br>ttgactgggctattgttcctcactgctgtaattccaaactatttcacacacatatttcgcaggattttcgatacagatatgttcaacataacctgccttattcttcata<br>ctgttcttgttgaagcttaaaaactgataagctatcatacagaatcatattcctattagcagtagctcaatgcgtctattccctttc<br>atggacaggttatatgttttatgttgcttgctaatgttgtatggatgtgtcttgtattatgctctctattcaatattgagatttagaac<br>catttaagaactatgaaataaacctggaattattgaagtattacaggcttgctacattaattgtattggttgtaggtctaattggatta<br>ttattagccgtcggagtaggtgcggaaatggcaaattcctaattcagtgactgaggacttgtaggttcattcctcgcta<br>cgtacttatttccgttgcgaaatggcaaattcctaattcagtgactgaggacttgtaggttcattcctcgcta |
| Contig47_<br>gene_420 | 1325 | gtgataattattggaggattaaaaaatatgaaaccattaagaacattcttgggttccactaatagtcgtggctcttgcttcctttattgt<br>agctttagacgtacattcatgaatgtgagtatttcacaggttgttgttgacttgaatactgacgtcagtacaattcatcaatcatgtcatttt<br>atactctcactgcatttatgctcttaagtgcaaagctcaagacatagtggataaaagaactgttttaatagtactgctcttat<br>ggtagtacattcaccgcatcaataagttcaagtgctgaatgttattgttggatgggcagcattgaaggtgttgctggtgcattaatgat<br>gcctgcaaccgttccatcataagtggaacatattctgtgaaaaacgtacagttgcttggcgattgtaggtgttatggtgcagttgcagccg<br>ctgtaggcccactcttcggtgggtcatgacaacatttaagttggagatatgatttgcagttgaatatgctataattcatttcattttaata<br>ttcagaaatagcatacctcattcgaacctatctaaagatttcacaacaactagcatattgaacattcaaggcgctataattcaggcgctataattctattagcggccttgttttatt<br>agtactagtatctcttgtcactatctaaagatttcacactacttgctcagtattattttgcagtattgctcaagcgtattgcagttaagtagccttgcatacttgta<br>aatcaagaagaaaatgcaaagtcctattgtgggtgggattattttgcagtattgctcaagcgtattgcagtattcaatactggtgactacctct<br>tcttaccttgcaatggtttgcttatttttgcagtattgctccaagttgctccaagttgtaagtcacaagaaaa |
| Contig47_<br>gene_421 | 1326 | atgaacctaataaagtatctgaatattatccataattttaggattaattttcataattttcccctttgttagttccgattagtagtcatcat<br>gattgagttagcttactattacttcttggaataattctaaccgaattttcagcactccattctaaccgaattttcagcactccatcaatcatatcg<br>gttgctattcatattcaacattgatgcattgcctttcctttaggattccaatatgcattatatctggttatctcaattatgatctaagtgtagca<br>ggtatcttgcaggagaaggcgtatcagtactatgctagtcgtaagttaatgcgctagttccatattctaggtgttattgcatttaggcttgaggctttcactttac<br>caaccgattttcgctgcagtactatagcgtagcttaatcaccaagtgtaagttatatgtagcaccaaaaattaa |
| Contig47_<br>gene_422 | 1327 | atgggtgttaatatgaaatgaaataattaaagattcttttccatctaaaaactaggaaccttcaatttatgttgtattgtc<br>agtattagttgcaacattacttttggagaataattcttctctattaggtttattgctgtagtcagttcctaatagttcctgagttaa<br>tatttgcaatgcaatgcgaaattctttgatgggattctgttgttatgaaatcagcattattaaatctgtatctgtattgaagtcctgagttaa<br>tgttggataatttaatacagttttaacttatgttgcaatctttatatctccatctcattattgttgcctctaatatttcgacaagttctcgacagttcatttg<br>tataaatattaatgtctcaagcaatatattgaattaatagtcctttagctatcatattgtctttatgttgtaatctttttattcctccaa<br>aggcattgtctgaagcaagattcgcaaatacggtagtttgtgatgaagctttaaacatttttgaagcagctaaagatataaacgattggtacg<br>tccatgctgaagcaagattgcaaatacggtagttttgtgatgaagctttaaacatttttgaagcagctaaagatataaacgattggtacg<br>taaagtaattatagtaatcttattagttttgtaattacttagtatccttggatgttacatcgttatattaactatgtccaacattatcaa<br>ttctttcaattattatagcccatactatagtatctttgctcaagggctactgcattattttattgatattctgatatagcttaa |
| Contig47_ | 1328 | atgaaattattaagggaaagaaattccgaaaaagaaagtttaaatcgtattattgaaatgaataggaatatatcttataag |

FIG. 9B-252

| | | |
|---|---|---|
| gene_424 | | tatttttaggtttaggagtcgaaattagccaaactgtgtcgaaatatattccttttagtattattccaagtatagtaaatgcaatactctggcctattt<br>taacaagaatagctatgccatttttagtattgacctcggaatagttcattaatattaaacgactcctcttcttcaattactgcaccatcattt<br>ggaatagaaatcaaagtgctgcaatgattcttgcaacctttgcaccttaggaatggcggccgttacaacagtgctatctagcttaacaattaatgatga<br>cagttcctattacagatccgtttaaatgatgcaacagtcagttgaagcagttgaaaatatgcaaaaatgaagtcaagaaaatgaagcaaggatatgccgggtttatcagcggttatatatcgttgaaattgacg<br>gacttgcatattacagatccgtttaaatgatgcaacagtcagttgaagcagttgaaaagaagagacatgccacaatcctaaaaagaatgattgaaagcaaagcaacatcttagaatg<br>tggaaactgacttgtcttcccaaacggtcaagcagtcaatgcaataaatgcgccggaattgaaagaataatgagaagagaattcagatgtaatgattgtcttgtagaaa<br>gagcaatgcaatcagatgatgcaatctctggagatactgacatgtgccggaatactgacaatgtgccggaatactgacaatgcattacttgcttagcttagtaatagatggatgcttgtgagaa<br>atggagcagcagatctaatttatttccaatccaagcaattttgcacgtattgtctcattgtcctgttctcattgtcctgttctcattgtcctgttctcattgtcctgttctcattgtcctgttctcattgtcctgttctcattgtcctgttctcattgtcctgttctcattgtcctgttctcaaaattgtatacgtgaaatctggtcacaaaatcac<br>gcatggtactcagtatttctatttccaatccaagcaattttgcacgtattgtctcattgtcctgttctcattgtcctgttctcattgtcctgttctcattgtcctgttctcaaaattgtatacgtgaaatctggtcacaaaatcac<br>acattccatcaaaaacataagccaagaatcaaccgtggaatagcttatattccaacaagagctgctacaaacg |
| Contig47_<br>gene_425 | 1329 | atggagattttgcttttcctgtgaattgtcttgtgttgctgtgttgctcaattttaatattttggtgtgttattcatgtgaaatttattcatgtaagattatt<br>gaatagtaaaagcagaatttttaaatccaggagaatatttccctgatgaggaactgaaacattaaagcaagtttattattttgtaatgatgttaa<br>tattctttgcttttatattatagtatttgaaaaataagatattcaagctaatgattatcgcgattgctgttttacaaattctgtgtcagtctatgcgct<br>ttaacttttgattatagtatttgaaaaataagatattcaagctaatgattatcgcgattgctgttttacaaattctgtgtcagtctatgcgctttcaatgatttctt<br>aatgattggcaattagtttattgatgcatattccgtctgttatgcatatttctgttctcgttctcttgtgaaagctattccaggtatactctgatataattaagaaaatactgaaacaaatg<br>ggcttgaataacaatcatactatttcgctataagtttatgcaatactggttatagctcattgtaagcttcattactcactactttgtgaaggtgttgaaactttaaattctgct<br>gtaatgtttcaaatctggtcgattcaaagtaatggtcaacattagccagtcaagcattgaaggtgacgatgcattgtttaatgtttgagcgg<br>atacatcatatctggtgtaggtactgcaacattagccagtcaagcattgagacatatcaaaacgtgaaaagagtaaacaaacgttag<br>atgagttggaatcattaattaaaatagtaataatagaataa |
| Contig47_<br>gene_428 | 1330 | atgatttgcttttcatgttgtttgctgtgttgattgagatgcttgcaggttttcatgcaggcctttgggattggcggtgaattgtaat<br>cactccaatccaatatcatttctttaacctcaaatgtgtgatgtgatcctaaacgtcctaaactgattcctgccggcacgccaggtcacctggaagcggtcttacctctgaaacgtcacctaaaacagcacctaaaacatgatgtgtcttggttttgtaggtgcc<br>tcacgatgataacagtacacgaaagcacaaaacatctaatagtaaaacagcactaaaaacatgatgtgtcttggttttgtaggtgcc<br>attctgggtcagtcatatctccaactctttagataatattcataccgatttcgttatattgtgtttaaagattttgttggtgatagtatatgatatatagcaggtggttcgagctgctactgctgcaagcggattgatag<br>ataaatctcctacctcttttagataatattcataccgatttgttatattgtgtttaggtgttcatgtgcatgtgtcttgcaagcggattgatag<br>gtcccgcagagagccattacttaacaatacatagcattttcgtgcagcatatttgagatatccaataacaatactatcgggaacaacttcagcattaagcatc<br>gcaaccacacttgcaggggtaatctgttatatctgttatatctggtgtgttcaaggatgccggatttttcàttaggttgtcaacttgcttca<br>attcgtatttttaacaataactagcattattttacaggtgctgtgctaaccatctcaaaaaatcaatcctacaaaattaaaagcgctgcagg<br>taatcgtaatatcatatattggccttcaaatgatgggtgtattgacataatattaagcataataa |
| Contig47_<br>gene_431 | 1331 | atgaataatagcatcatcttttacttgcaattctctatttgaaaccagtgccacatcactgttaaagttgctgaaggtttcactaaccattgcc<br>aacaatagcatcaatcatcttttacttgcaattctctatttgaaaccagtgccacatcactgttaaagttgctgaaggtttcactaaccattgcc<br>cagcattgggaatcgtgctgtgacaattgtagggattatcgctttcaaacagacccctgattgggctgctatcctgacttttacttatcatt<br>ataggtgtagggggctaaatctattctcaaaaatgagcttacattaa |
| Contig47_<br>gene_433 | 1332 | atgaaaagttttgagtgttgcattaaaattccaatgaaaacaatagtgttttttcgcattaataatcattcagacattcgttcaaatgga<br>aataattgatttgttcggtgcgctttgacttgactggagtcaaagaacagaacgttgatttgctttcaaatcaggattatatatgttaatgtataccg<br>tcattcaatgatttgcctttatgtcatctctttctcacaacaagagtggcttcaaaatcagcatatactgtcctgagaaaatattccatatt<br>ctgatgaacttgcctcgtgaggaaattgataaattttcaggctagttacaaggtcaaccagagtatgtcctccgaacaggatttat |

FIG. 9B-253

| | | |
|---|---|---|
| | | agtgatgatactcgaacagttaatgctattccagttacattcgtagcaattgtatatgaaatagcattgattgatgaacttatgcatttt<br>tcttaggattttattggtgttcttttctgcaatcatatttttagaatgaaacagattgtgaaatattttcagagctaaaaagacatatgtaaa<br>ctaaattatattcttatccaaaatcaatgatatagctggcaggattccattaacaaacaggagtcgaattgaagtcgaattcgaaaaggcatgtga<br>gaactcctatgataaaaatgtcatctatattaaagtcatgttacctcggaccaatattaatgtgggtttatatgttattgtcctggttacat<br>tggcaatggttaattcaggatacacccattggatttgaaactgataagtgtaattgatcattcattcattctggtatatgttgcctacttcatcact<br>actctagctaatattcctgcattaattgacagatggccacgtgcatatgccacttctgtgcgtttgaggaagtcttgaatattgaagataaaat<br>cataaaatccaatacaaatgataatctgaaggaaatagagattgttgaggaggatattgctcaagaggctaagg |
| Contig47_<br>gene_438 | 1333 | atggattgcttttttatgttgtttttgctgtgtgattggaggttgctttgcaggtttcatggcaggccttttgggattggcggtggaattgtaat<br>cactccaatccaatattatctttaacctcaattggatgtgatcctaaaacgtccctaacgttctttgcaacaggtcctgcagttatctgtg<br>tcacgatgataaacagtacacgaaagcacacaacaatctaatagtaaaacagcacctaaaacacaatggtcttttggttttgtaggtgcc<br>attctgggtgcagtcatatctcaatacatagatgttgaggtttaaagattttgttgtgtaatatgtatatgtatatcaacagtattttagtttt<br>aataaaatctctacctcttagataataattaaaactgatgcaggattattttactctcattgcattgcatgtgttctgcaagcggattgatag<br>gtcccgcaggagagcatttatcatacagcatttcgtgcatatttgagatatccaataacatactatcggaacaactcagcattaagcatc<br>gcaaccacacttgcagggtaatctgttatattgttttaggttgggtgttcaaggattgccgattttcattaggttatgtcaacttgcttca<br>attctattttaacaataactagcattattgcttcaaatgatggtgtattcgacatatattaagcataatata<br>taatcgtaatatcatatattgcttcaaatgatggtgtattcgacatatattaagcataatata |
| Contig49_<br>gene_6 | 1334 | atgaatttatataagatatattctatctgcatcagaagccagagagatcattcacatccactgccaattgccatt<br>ctgtgcaagatgctgctgtgaatcatcatatctgcatcgctcattcatcatcatatgtagcctttcaatgaatgccctggctttcttc<br>tctttgtcccaatgattgtagatgggcttgtgcagagtataccgattatgaagcacacaaatttcagaagattcataacagcttcttattga<br>ttcgcttatgtctatgtattttacatgtttgattgaacgctttatga |
| Contig49_<br>gene_9 | 1335 | gtgaagatattgaaaacttgattgaaaaacttgtgatattctatcaatactgattgtattgacatttcattctaacagcttcatttgtt<br>ggatttgaacacaacctatatcaattcatgcttttgttcgatacaacattatgtgatccttatagtctcattcatcttaagctgcttaatt<br>cggatgacagaaggcatatatgaggaaaatatctgatttttttagcatccatatgaccttgtttgctccctttcagttcagttcat<br>atcagcttgataacaaaactttgattctagtaaggtccaagtacttatcgtactgctatttaaggaatcctacaagtatgcaagaagttttccaagg<br>aacatcctttgataagtcgtagcattattcagacaataaccacagtagctcgtgatgggctcaacattgcatcttgaataattccgcaatccctaacctat<br>actacagcctatgttcgtatttcagacaataaccacagtagctcgtgatgttgattcctgaagccctgtagtcagtcagtcagttggc<br>cttttgatgttgggtactcatgtttcatgtttcgcaagcttgcataccttgaagagaaaatcaggaaaatattacccacaagagggatt<br>ccatgaaaagataaacacagtcaggagaagctaaacaaatctgcagaaaaacaaggaaaatcaggcaaagcacttatccacaagcagagaaa<br>ttgctgaagtaaggaaagctaaacacagtcaaacaaatattaaaaacctgaagagcgtatagattaccttatagatatgattgagaaaaag<br>gaatag |
| Contig49_<br>gene_22 | 1336 | atgtcctatcaagaatcatctgacaagtctcttcaagataaagatgaaagcgaagcagcgccaagatagaattgttaagacaagcat<br>aataggtattgttgaaatctaatctaatacttgttgccttcaaggccacacatcggaattcttgaaattcattgatgcagtaaaca<br>atctaactgatgcctatcctccataactattattggagcttgcaggctaagctgcaggcctccagataaggagcatccttacgatacggccgt<br>attgaatattttgcatctgtaattattgcagctatcgtcgttctgggcggaatcactcattgatgaatcatgccaaagatctttaatcctga<br>tgttacaagctatactacagtttcattagtcatcgttagtgtctgtaaaattcatattgggcgctacgttaagaatgttgagagg<br>aaatcaattcacaggcattggttgcatctgaagcgatgcgttcttgatgccatatgtcattttccactttgattgcagctttagtctccata |

FIG. 9B-254

| | | |
|---|---|---|
| Contig49_gene_28 | 1337 | ttcttccatatttctctagaaggatcttggagtgatcattccattgtaatcattaaggcagtatagatatgctaaggaactgttgacag<br>catgattggagaaagagtggattcaaagcttagtcgcgatataagaggcaattgtgaatttcctcaagtctatgagcatatgcttgagcc<br>tgcataactatggtccagatagcatgggaggttctgttcatattgacagtaggaatgctagcctaacagctttagacatcataatctaactcgcttg<br>atttcaatgaaaatatttaatgagtttccatatagtttcgacagtaggaatcgacgattttaaggatatatgaaatgacctttaa<br>tgaaatcacctccaaatatgattgaggtcatagaatacatgattttagcctatcctgaagagaagctgataa |
| Contig49_gene_32 | 1338 | atgaatagagaacgagatagaatagaacacgtgcatctgcagttgcaattattggaaacatcctccttactgtattgaacatctcagtggg<br>actgatgtctgaagttacgctcttatatcgaagggctcatacaattccgatatagaacatctgtaattgcatatgttgattcaagatag<br>ggagcaggcctgcagataaggacatccattaggccacggaagacgaagcaatctctggcctatcatgttgtattcttatcaatagttgcc<br>attgaagttattcaagagctttccataagctctcttgagggcttgaagtgccagatcctagcagtgtaatgcctttgtagttat<br>tttggttaacctcttcatgagcagctatattcattcgctgttgggaaaaagctagaagccctgcgattgtagcagatcagaggtg<br>atatattgtcatcattgcaatattcattgtagcaatagacaatctaaacatattatggtaaattgccttcagatgagtaatcaagaaataaggga<br>ttgattgctaggactgcagttattgtgagcaatagacaatctaaacatattatggtaaattgccttcagatgagtaatcaagaaataaggga<br>tgttgccaattcagttactgatgtatgcatggaggctcataaaatcaccccataggttcaggataagatactgaaatgtgatatgttcaggcagtgcatgtt<br>cgcctgatatgagcttgagggaggtcagtatgatcatagtcaattattgatgaggattcttaa<br>catccttgccctgaagggtgcagtatgatcatagtcaattattgatgaggattcttaa |
| Contig49_gene_33 | 1339 | atgaaagaaacactgattaaggagttaaaagagaaactgacaagccagcgtgaattgatttattgattgttctattttagt<br>aattacaattatttgtgaacttatgtattaattaatgttaattctaagataaacggccagttaatcaaacaatgactaagccaggttatttcttt<br>taaataaggtctga |
| Contig49_gene_34 | 1340 | atgagcgctaatgaatgaaatagaaatatttgaatctgaaatgaatcgactccaaaggaactgtcttgacaatcaaaaggaacttgt<br>ccaattgaaggatgaaacttccggccaaggagctgcagaatatatctccttcggaggagtattgtaattgcctttagcagttctttaatct<br>atagatcctacttcagcaataacacaacgcgattgaatgcgactcaggacatccatcagagacaatatgagcaatgtcttatag |
| | | ttgtctgattcattagatttattttacaggagtttttagtcacctattcggttcacagccattggttagttctctattctattggaagtataatctaccgtctaatctgatct<br>agttttaatattaggtgttttaagtcacctattcggttcacagccattgttctccagcattgcttccagcattgctaagttgagttgctaagttccttgaaattgctaaga<br>caagataagctttcaaaagcttttcaaaaagccaatgtttctcaagatctctcttaaagccaatgtctcctaatcaatgaagaccttgaagaataatatgagcaagtcaa<br>aggaaaattcaaaatctgtctaaagctcacctaagagctcaccttaagctccaaggagaagctctcagatctctcttaaggatgagacgttgatgaatccaagcaggtctaagaacaaagc<br>acagattatgcaaccaattactcaccttaagagctcaaattcaagctctaaattcaagccaaaagccaaatccaagaaattctgctttcagaaggat<br>ctgtcaaagagagaaagtctaaattcaagctctaaattcaagacaagctctaaattcaagctccaaaagatctctcttaaggatgagacgttgatgaatccaagcaggttcttagaacaaagc<br>aggacacagagcgatctccagacagctctccaagagatctctaagatctctaagatctctaagaaatctctgagcagttggcactacagaaacagtctatgacaataatg<br>taaattaaggctatctgactctccaaagatctgcctaagagaaatgatgatgaatctaaatctaagctaagctgggaactgatgcaagtgttggcactacagaaacagtctatgacaataatg<br>cttcagatgacagctatttcacagtctgagaacactgcaacttcattaatattatgatgcagtgtgatctcagactgcaggggatctgatgactcagatctcagagagagggcct |
| Contig49_gene_39 | 1341 | atggatacaactgttaaaactgttatcaatccatcttgttgcagcagtagtgcagctattatctctactgcctttacattaggatggtttggttt<br>taaaaataacgtatttgcatttgcatttgttatgttatttcattgacaatattgtaaaaggcatttggcgaagataagtggat<br>tttctacatgctatggatggaatcctttccattcgattttctgttcatattatgactatttatttatttatta |
| Contig49_ | 1342 | atgagcagtgttgcaggattatccaaatacattagaacattgcctaaagccaaaagcacttttctaatgataatcgtattgagctttatcatagg |

FIG. 9B-255

| | | |
|---|---|---|
| gene_41 | | cgcagttctcttttagtaaagcctatgagccttggaagcggttgagaatttcttctacggtggtgcattcgattcgtagtttatggcttc<br>ctgctattactggtgcaaccgatcagaaatgggttagcaccctagaacatcctccacttcgacctgtttataaactcattcttttggaat<br>caatgaccatggcagggtaataagcatcatgtaaggaacaatcatggagcgttacacggaaaccttgcatcaaatcgttcttgttgaatcattcagccattgc<br>agtaattgcatttgcattgattattgatctacaagctttttaaacaaccagaaaagcgtctttgacttggaatatttacaaccttcttcaaggtaataata<br>tcatgattggagtcttcttgctgcaatctcattcattcattcaagtcaattgaagaagcttgaaatccccaatgaaaaagaacttaggattcggagcttggaaatcct<br>gcaagtgcagtctcttcatttcacatatgaacgaaggttccaagtcaattgaagagctttttgcgacaatgctggagaagcaattgacacactgttggggtct<br>gcagcttcagaaagccagacggagatattaaggcattgttcatttgcacatgcaccccaggacctcttgagacattggaggttcaaatatg<br>cctacaatccttgcaaacagattgattcatttgcaatgttgcacatgaacatactcatcaaagcaagcagattcgtcagat<br>taaaatcgagtcatcagtgagaaccgcattgaaaatatgaaactactcatcaaagcaagcagattcgtcagat |
| Contig49_<br>gene_75 | 1343 | ttgaaagcaggagttcttgtattcacaggaagtctggttgctatcgaccatcttcatcgaccatctttctatcaatcatgctcttgcagcttgttcatgttgagctat<br>tatgatcttatatttggatgaagtagtatccaaatgggattcgtagtggattttcatgtcgtgtaggaaacaattattg<br>tagtacattaacttcttgccagcttccgctgctccaacactgcttcagtattcttcctgcattattcaatcaataattgtgagcacct<br>aattccaaatccttgattcattgattgcaccattgtagtgttcttgatagcagtatatgtgaaagtgaaatcgagatcgagatcctattcca<br>cggcagtaaaagaccaggtagaacagagggctagtaaatacctcttgaaattccctatatctcatgcaagtaacatccggtattaacca<br>gtgccttcttgtaaacgtatcccttattgcaagcatatcgcttaccacccctaacagcatagcagttgtttaccaatcctttaaggttttcttctacgcaagtctatcagc<br>gactttgcttatgcttctcatgctatggttgaatcagtggcttgttccttaagtgctaagaagtgcaaagcaactctataactctgtatacagattc<br>ttgtactctctcatgctatgggtgaaatcagtggcttgttccttaagtgctaagaagtgcaaagcaactctataactctgtatacagattc<br>cagttttagaagtagtaaagacaacttatatacatagcggaggtacagtgtattgcttactgtagtattgtataacagctctacgaagagatcgctca<br>gcatttattgcagacctctaccggctcatcaatgttaaggaattcttaggaacgattag<br>agaacaacttatgaaatgcatccaatgttaaggaattcttaggaacgattag |
| Contig49_<br>gene_77 | 1344 | atggcgtatcaaggtagtttcttttaggtattcctgcttcagcgtactcagtgcaatgatgctgtcctaatcctttagttcattgga<br>tccaactccaaataatcctgtacttactgtattgtgatatctgcttaatatcctttgacagtactgcacagaaatattagtgaccaag<br>acaagatgaatgagatgcaagcaaattcaaaggcttgtgcagaagaattaagagaagctcaaaaaaagtgagatgctaaacaaatagcaaaagtt<br>caagcaaaaacaaacggatatgatgcaagacagagcaagttcaaagaccagttcattcagaccaataagctcactttaactcctatctattaat<br>attcgattgatgtgcaatccgctatacgttcacttactccattccattccagctgttatggtatgggtattttcatttgtactttgaatggtcaa<br>taggacaaatgcttacgcggtaacataactccattccattccagctgttatggtatgggtattttcatttgtactttgaatggtcaa<br>atcattaggaaatttatgggattcaagaacggtttctag |
| Contig49_<br>gene_83 | 1345 | atggcattccttataataacatgtctatttcttcctcggaagcggaaagtcatctaccaaacaggatctcttggaatcgtagtcac<br>cgcgactcatggcatctacggtctctcacacttaaggtctccaacacttaaggtcttcacacattaagggcttttgagataggcttttgagtacaatcatcttcatattcctaaatgag<br>agatcttccactgtttgaaacacttaaggtcttcacacattaagggcttttgagataggcttttgagatacaatcatcttcatattcctaaatgag<br>attgatgtgatcagaaggcacagaagacaagattaggtataattaggtataatcctattgaattcattcagtgcttaggatcgcttgaagcaatatatt<br>tttaagatcattggaaaaagcgaacattgcaaaacagttagattcaaaacagtagattcaaagaggctacgacggagcttccggtttatatacccgcaaaggagg<br>aataa |
| Contig49_<br>gene_84 | 1346 | atgaaagaacaacattaattatttagcagtcattgtgctataatcttcatagcaccattagttatgtacagcggtcttggtgaagatgatgg<br>atacttcggcggagcagacgatgcagctggcgaagctattggcgaagctattgaagaatctgttttaaaccatggttctctcatcaatatggggtg |

FIG. 9B-256

| | | |
|---|---|---|
| Contig49_gene_85 | 1347 | aaatagaaagtttattattcgctcttcaagcagctataggtgcaatcattattggttacttcttcggctactgagaggacaaggtaaagaagaatag |
| | | atgcacattatgaaggatatttaccttgacatttgtcgtcgtatcattcatcgttgtcgctcgtacggtatctatcaaataaacaaattgtagatgaaacacctgactccaaggcattactgcgtcgtcagtggagcattcatgttcatcttatcatcttaaaactccctccgttactggaagctgttctcaccctgtgtgttaacggattagtgcagcattcggccctgctgtaactgctgctactgcaactatcgtactcttgttccaagcaatctactgtcacggcggtaacccattttctcaatggtattataggccattcgttgctgctgtatacaaagcttgcatcaaagctaatatttcatcaaccattgcaattttcttgcagcattcttagtgacttattaactttgtgctacttcattccaattagcttcgcattctcctgctcctctcttttggcagcgcattaacaaatcttagttatctttgcagtaactcaagtattagctattggtgaagtatcttaaccgtaatcatatggacagattaaagcttacaaccaaaattattagacaaattagtgtattagctccaatgaagcataa |
| Contig49_gene_101 | 1348 | atgagcgtatttgattatatttgccatagaagaacctgaaaagaagcttctttttataaaggacggcaatttccagtatgtgcaagatgtacagattttatataagtgaatagtagcatagctattcatattttaaatactttccattaaccacactcttaacaacattagctatattgaatcttgctccttattccatgtgcaattgatgaacaagcaatttgttaaacttttgtctttcttttaaattttattaataattgagatgagagaaacaataatgttctacgttttgattacaggcctttagaggagtaggccttatatgataatgaagtggttgttaaacttttgtcttttaaattttatttattaa |
| Contig49_gene_133 | 1349 | atgtcaagttttgtccgaaatgcgttgtgaaatctagatgcggttgcagtgaaatctagaaattctagcatctcctgcttgtcttctctctcctagctcattgaagaggttaaggaaagtcttctcatggagctgaactagcaatttaaatgagcactttagttcaaatttaaatggcttaatgagaaatgctttaatcaggaaaccagtagtttttcacagtcaactcaaattctaatgaagcagcaatttcaagcaagtttaaaaatgtaataatgaggcaaatcccgccaataatgacaatcaagactatgctatctgttgcctgtatatcctgcaagtcctcataattgtcttcctcatgttcattcctatgtaattttaa |
| Contig49_gene_153 | 1350 | ttgattcctattatatcctgccaagtcctttaaatgtattaatgcggcatgcatttaataatcttcatgcatacttctagcacacttctataaagtattctcagtgatcatttcagcatctgtagttgccatttccacttgaatatcctgatgtatgagacctagacagattaagctcctttaatcataaggccataattcctcatgcattaaggcctattaatcttcatctgattccattcttgttttggttgtataggattatcctgcagtattcgttatcttatcgttgtgttttctcagacgtgttaaaaagaacgataatgtattaatcgaagcagctcagacttaggtgcaaacaattggataatctcttgcttaagatctcttgtcctatcacctcaaacctaccaacatgttgcgattaagcgcttgaatgtagctttaatgtgtaccgtatctgctgagatcgtctgctgagatcgtgagatcgttcttatatgattctaactgcaagtcaattgttccagcctggaactgtggtagttggtatgatagttattggtataatcggtatttatttgattatgggattaaaaagcgcaagagagatattcctgtaa |
| Contig49_gene_169 | 1351 | atgtcaagttaatttcaattcctactttgcctttaattgtatcgcattgatatgtgggattctttcattataagtactcgtttgttatgccttggcttattggtaagctgagcaggcggaacggaaattattcatcaaggtcctccgtcccattgtgaaatgggtgaatggtgtattggtataattcggattcatcataggatcttttgccgaataattctcttcagtattgaccttcagcttgttgtttccttctttgttcttgcaggcataccattatgtgggtgccctcctaatgtcatggcatggttgatgacctattgtattctcaataagatcagagaagcagtatcaataacatgcttgcagattaagcatgaatagaatcaggccttgggtttatttcaatgagaagtatgacgtgcgattataagcatgacaatgcttgaaccctttcttgcattcttgaaggtaaagctcatatggaaggacattcatgtcttgaaatctcattattggaaggataaagctcatatggaaggacattcatgtccgtaaagtttttctaccgaacattatgaggacgcaaggcttgtaaggccgagcggaataggcattattttgtattcttgtataattcattattctattattggctgatgcctgggtaactcatgatcagactttatcacacttgcacagttgcacacttgcacagttgcacacttgcacactgct |

FIG. 9B-257

| | | |
|---|---|---|
| Contig49_gene_173 | 1352 | atggattcaaaaggattaatcaacatagaactttatttgcacaatcatcatagtcatgatctgatagtgaacttcctatcctagagcatag catagattctgcaaatgtgatatggatgaaaactcccaagccgatttttacttattcgatatcaactagcatagatcaagtaaatagcaataatg aaggattttcaaagaaaatctgttgacgaaactattatacaatacttgtaagcagcaatgaaatatattggaattcaac aacaagaagggaaaagctaaaatccagccatccatataatgagagcacactctataataacatttctataataatcatgcaagtagaagataa cataattaaaaagaccctaacaacaataatgagagcacactctataataacatttctataataatcatgcaagtagaagataa |
| Contig49_gene_191 | 1353 | atgaacaaatatattaaaaaatggacagaatcaagtctgatttaaagatcatcggtgtttgattatcggatccgtattaggaatccttgtacc tcaatataagttaattggacttccaggagagctatttgtaactgcttaaaggctattgctcctatttcttgtatttatttagtggcttcagctc tatctaggcaagcgaaggaataggcagtcgttttaaaaacagtaatggttttatattttattctgctatgtgtaagctgtaact ggaagctatctcttcccagttggcatgcattgacagacgctagtgatgtggcagcacctggcggattggggaagtcataagttccatgctct taagatctttgcaaatcctttgcaatcctatctcaagggattatttgcaggatcctttgcaaggaatttgctctaagaaaa ttgctagcgacagcacattggatgtttttctccgacttggcagatgcaaccagcttggctgttagggaattattcaatttgccctataggtatt atggggcttgtattgtgctgtatccgaaagtggattaagcatttcatccaatacggtcaatggttcttattgcttgttggatgtatttgcaac ggttgcattgtaacagacctatcattgcagcaataaacattcctgtaaatatgaggcttgtgaagatttaggcctgtacaggcttctcactcaataagt atcctctaggttccacaatatgaaggtgctgctgttacaatcacagttagacctgcagtaatccataccttaggaatcagcgttga cttgcctacaacaattgttctatgtatcattccacttcttcgcgttcctctgtgtagcaggagtt |
| Contig49_gene_201 | 1354 | atgataaagaaggtgacaaatgtgattgatgaaataaccgattctctatttgcttaaagatgactatatttcaggatgatatttctcttgattgc tgttatttttatgattttttgaatagaacactccgattctatctgcttcttctgctctttattcctgatgggtacagtacatctcatgctcttcttctttg ccatgacaagattgattcgcgaaaatggttccttcctctgcttcctatgcattgccatcactattgattggcgaaatctatcaatttgca gcaggtgaagttgcatgatggcattatgcattgactggagcagcattaggagcgctaaaggagattgagaaatctatcaattcctg aactccaacagactggagaagaatcgtggaaagaatagcgaagaagcatgtggattgatgaatagcagtttctgatgtctaaagaatccttcctg gtgaaagcgttccgcagtttcgtgatgtgaaatcataaaggcagtcttccctcttgatcaatcatctgatcaacaagcttagtgaaatcacctattgataagaa gttggcagtgaagtatttgcgtacgtagtgccatgaaatcagtatgtgccattgacacattgacacaagtgcaagacaaatggcacttgctcttgtcttctgcattgataccttgccagttgcattggcca gattgaccttgctaaaggcagctgatgaaaggcagttaatcagtaatcaagtctggtgaggcgcttgaaacattagtgcttgaacacctct actgcgattatgcagcagcagcagccaatatatgtaattagcagttcagatattatctcctaaaggatgatt tgtattgataagactgtataagaactaatcttatgtagcagtttcagatattactcctaaaggatgatt |
| Contig49_gene_205 | 1355 | atggatgagtcagtcagctgataagataatataagtttgacgtttgtcagttcttcattgacccatacagcatcaacaacgattgtccaataatacaaccgattgtccattgaatcagcaccttccctgagc acctattcgtactgactgatgggaagagatatgtcttttagctttctttcaagctcaacacgttagattgttcagatagattcttcgcttccata ttaagtagcatcatcatttgctgttcttatcattcttattccatgctctctcggtgagcgagcattcggttgttgttgttcttatagatgttcctctc tattccgcatatttcttgctcatttcattccatgctctctcggtgagcagcttgttgttgttgttgtgaaaatctgcaaatcaggaaaatccaagttctgatt ctcttgctaggtcctaggcctgaaatcaaacgtatcaagactttcagagtttgtaacaatcctgaaagattagaaaatcatgcacgaagcagtgtaac gcaagaagcaaatcttgccattgtaatcagcaaccggctatcattgtatcattcttccacacgaacatctcttccgaatcctaatgaatatctctgaactgtaattgtgttgg attcttaggttcgttatctccacacgaacatctcttccgaatcctaatgaatatctctgaactgtaattgtgttgg cttattcccctgtgttagcattgtatctccgcgagcgagcatattattgattcgttgatattgcaggagagaaacatcaagaagatgctagatccggcaagcgcaat |

FIG. 9B-258

| | | |
|---|---|---|
| Contig49_gene_206 | 1356 | gattag |
| Contig49_gene_207 | 1357 | ttgcagttcttatcattcagtgaactcttcgtgtggaacgttcttgtcgaacagtgtattcatgtatcctgaatcggtcaggcagccgtttcagc<br>agtttgagaagcgacgtacctctgctgttgggaatcgttatcttcagtgcgatatcgtttattcgtttattgcgtaacctgattgcagatatctctata<br>actttgtagatccaagaataagagaaggtgaggaaatggatga |
| Contig49_gene_207 | 1357 | atgtctccctattaatccgttaacgcttatattccaatatggttgtaagccctgaaaagattgctaaactagaagcatattgggtgtaaatca<br>gccgattactgaaaaactgatcaattggttaggaaatattatcactgtgtttgaacttcctaatatacagaactcctgtattgcagtaa<br>ttgctgaaaagttcacagcatcccttatcttgatgctaaccagttggtgattcctgaatattggcttgcttctgaatgagttcttgcaggattt<br>aaaagagacacttgattgataggttgtaaagtatactgttacgtattgcaatctgcacctacctttgcctgatgcttgcttgttgtaatggt<br>atcagtatttatctggatctcggcgttcccagtaagcggggcgttccgattgggcgttcagatgtgtcctctcgattggttgaagcacc<br>tgatattgccgcattacgctgagcatttaggagttgcatcaattgacaagcttattgaagtaatgacaacccgaatt<br>tacttcctcctttgccaaggccaagaggaggaatccgatgacccttgattaa |
| Contig49_gene_217 | 1358 | atgaaaacataagacaaacataagcacaactagcacaatagaagagaaaatgctcagtcctctcaaaaaagagcatacctccatatttctcatcttcatattcct<br>gcttatagacgtttactgtaacctgtaacctcaccctcccatacatacactgcagacattgtagatgtgggaatacagacttcaactacataataa<br>gcgttgaacaatgatgatgaacatgtattgacccagttctagcaacaatagcgctatccttattttcaagcaagtatcagcagcatatga<br>agggacttaaggaaataagctatgaaaatacatagatatctttaagcgactaaattccaacttaacagatatcaagatcatccctcataacacgtatac<br>aacgatgtataccaaatacagatatctttaggcctgctttacaccatccattcgcatcatctcctattcggcacttactgcaacatcatcaaggatagaagcatcatcaagcaa<br>tgaacttgaacagacctcctatgattattgtgacaagatcaacagacatcaaggagaaatactgatggaaatactgtaataacaagtcatttcataagcagga<br>tttaaggtatgcagacgaactattgaaaagacaaatgaggagttcaagaagacaaatctccatgtattattcaaaacctctctaatgattcctgcaatga<br>tttacgagaaggaaagtttgatgatagtcctatactttggtcttgaggatttacaatcatgatgcatatgatataagatagagacaggactcctgtatctgaagaagttgg<br>caatgatattgaatgtgacagattgtaatctcaattcgatgcttgaggattacaatcatgatgaatctgactgaaccatcatagcattc<br>atccaatacctccacacagattgtaatctcaattagtgacgaccaatagacaaatgtaaggaaagccatcaaaacatatttgactcctaatggata<br>agaagtcctgaatacagagatatcaattagtgacgaccaatagacaaatgtaaggaaagccatcaaaaacatatttgactcctaatggatacaagct |
| Contig49_gene_218 | 1359 | atggcaccaagatagagaagattgcctccgaaaagccatcaaaaacatatttgactcctaatggatacaagct<br>aaagctaagacataacagtcattgcggtatccatctgcggtatccatctgctatatatcatcacagttgtattctatacatcaaatgcagtcttctcctat<br>atggaataaactctgaaacatgaatctggaatatataaacctctaatcacagttgtattctatacatcaaatgcagtcttctcctat<br>ctccaaagctatttcctcttggagataacaacagacatcagctatataacaaacagactatcagcaagactatcaccacctatccatggaga<br>gatggataaaaacaagaggagacatcttatcaagataacaacgatgtagactcactacagacaagacttgcaacattgcttataccaattgca<br>tctctggatgattacaatagttggacactcgtcacaaagcattgtcacaaagcatcacagcataccataaccagtactaactatagggaagacaatgcaacattagggaagacaatgtgaacgacgattgaagagtc<br>tttttaatcataaatctcaagacattcatacaatcaggagaagagcagtccatgaaacattaggaagacaatgccatgaaaactgagtcttgagcggtattc<br>atttacaggccatgaaatctcattcaagcctctcctccgcccctatattggagacagtcgttgaaacagcttgaacactcctattcagagataacaagg<br>gtgcttcagaatgcaatagctgttgagcaagcagcaagtgcggcttctttgatatatacatcaagctaacactccataatggagataacaaggtat<br>gaacatgtccagactgcaatggcagcaagtgcggcgtttgtaatactcaagctaacactcctattcagcagataacaaggtta<br>gaacatgtccagactgcaatgggtgtgtgttgataatatcgtatatatgtttttcttatatcgtatatgttttcttatagcaatataaccgtattcggtggagaacc |
| Contig49_gene_225 | 1360 | atgatattcgtaatcaattggttcctttatcattcattcattgagatttacaattctcatttggagc<br>cgacttgcttttcctgtattatcattggtcagcatgaatttactcaccctttcggtcctattggctatggctattaccgcattaccgcattagcgt<br>cgcttaaggttatgaaaggtcggtcggtgttgataatatcgtatatgttttctttatagcaatataaccgtattcggtggagca |

FIG. 9B-259

| | | |
|---|---|---|
| | | atgcacagatcattcctatcgtgctatggttcatcggtctgttcatagttatactatcattccaaatcttttaggcaaaagtctatcttacaat cagaaggattttaatgttttcctcgcagcttagttgcattcggtttgcttgagcttgttcgttcaagatttaagcatgaagtttctctccat tgttaaggattcaagactgctcagaactcttggcaagtctaaatttgtaattgcaattactcaattgataggtcacgatcctgctcatcc tattggtctgacagtactgcgattgcagatttgcagatggttatattagctgcaatgccaatgcaattcattttgatgtttggcttgcattccaattgtatattgc tctttggtaacaagaaggatacaatcataatggctgcttgttcttcgctgtttctcgcgaatacagacttaaaagagaacaacaattaggttaag ttttattagctcttatttacaatcatatagcctgcttattgctgcttcaaagacttggtttgtcctcttaacagaacaataaacagtatggcgctgct gaagttctttaattggttcctactggcattattgctcaagcgatcattgtttctgctattagacgtgatagcaatgaagttttaa cacattcctgttcttaggcctctttgtctgtgactattagagcgtgatagcaatgaagttttaa |
| Contig49_<br>gene_227 | 1361 | atggaagaaaagaaatagaatctcagatgttgagtgatgaatgtaaacttagattccactgtagagaatataatgaaattgacaa gactgaagaacttgaagcgttgaagttatgagaattgaaagaacttgcacttcctctgaagtaagaaaacatagtcattgacacagcca gtgaagtggttgaagcggaatgaattggtaagcgaatagaagactgtaaaatctgtgaatctgtcaaggatgaagagaggagtcaacatcctcttgatgtagaa tatgttgaaagaagatggaaaacgaggataaaagctaggcaactgggatcagaatcatcgaaatcatcagttcatctctcagttcctctcat cgaccaggtcatagctcatgaggaatcgtggaaacaatcatgagaactcttgaaacgatatgatgatgatgttcttctattgtcatccggtgtag gtaagtcaatgctcgctcaaggaatggctgattattgcctgaagtcttgatgactctgaaagcagcagaacagcataattat ccattgatttaggacagtccctgcaggtcagggcatcttttgtctcttgatgactgaacaataaacgatattcaagcaacgacaattcatcatctt caccatgtttgcaactcaagctaagcaaatacactgtctgataaatcagaatcagtaaaacgaggatataaaagatttgaaaatcatgaacagaaaacaattattcat gctcatgccgcgcattgctcggtgctcggtgatgtaagcacagcattccacaatctgaagctctttgtgaatccctgcacacgaacgtgttgaaggcggaat gattcacaagctcataagggagttttatacattgacgaatagtacagtgagcgagaggatag |
| Contig49_<br>gene_231 | 1362 | atgagttcaggattaactacaggataggattcctctcctaataattttttggaatataaatactgattcttgcttcacaggatgtcttcacaggagtagtaaaagccgc aaatccacttaaacttgaatattgcaagttcagttgttgaacaattcagtgcatcagtgcatcagtgtaccacaaattatacaacaattatggaa tttacattgaattcattggcggattgcatttcgatattgattgttaggtaggatatg |
| Contig49_<br>gene_232 | 1363 | atgtcattgcagaatcattaaagaatcatttgttcctaaatggagatgcgttaacttgattttgtttaatttgttaattgttttcttcttgtgctgcccaaggtgt tattgaaggagcagatcttcttctcgttgcaaggcaagtctgtttgctggtattattgcaaatcatagcagttgaaccaatcagcaa tgaaatactctagacattgaattcattgctacttcaaaataccaatggtcaataatccaatcattgcgaggcaatgtatgacttgactttaagcagctgactccattga |
| Contig49_<br>gene_242 | 1364 | atgtatttgactaagttttgtcctaaatgcgagagagaagatgcaagatgttggtcaattctgcagtaactactagcaggtaactactagcagctgtcctatcatgactctcaggagtgtgaa tcaaagaagaatgaaagaatgaaagaagaactcttcattccccttgacaagaggaactctagatgcctaccaagaaatcttaagcgctaccaagaagcttaagcgctaccaagaagctagatgcccctgaagagaaatgagattgatcctg tccagcattcctcttcactgcggaaacgctgacaagcctcaaacattaccatgattaagcagaatactatgctccactttgtcaataga ggggttcttttctataataatcacttagatgagttttcctatgctcatcagggcttcagaatacctatgctattcctactgtcatgacctgcggacgattctaagcaagattctacgatgca aatgacacattggttaaggaggtatacactgataactatga |
| Contig49_<br>gene_243 | 1365 | atgaaatccaatgaagacaatgcaagcaagaaagaccaagcaagcttcaaagaaacagaaagagaaatcgatgacatatcagaagctgacataga cgaacagatagaaacactgaaaggaaaacaagaagcttaagcgctaccaagaagaatcttagatgccctgaagagaaatgagatctgattccg gagggtcatgggcttaactgacgagcttaatgactgcttcaaattgtaatgactcttctaatcctgtaataacattgctagcaccgaaatcctaactgat gccgactttcaagttcattagttcatacctgaaaatatttggagtttcatctgcttgtgctagcagcagagtaataccccgaaccaatgagtgaggatacctcagtatcatca tgaattttactaagtaaagatgcttaaactggtttacctatgcttagcgacagtttctattagcgacagttctatgacatctgctcattcatcccattcatttcattacaacaaccc |

FIG. 9B-260

| | | |
|---|---|---|
| Contig49_gene_247 | 1366 | ttattggaacatatcctgaattccgcttatcaaccaatatttttgaataaatatattgctagttattatattcttcctattgatgcttaattat
gcatctaaaagaggattcctgatgaagaggtaattgagaagataagaaatatgtccatcacacattatattcctagattggcagtgat
tattaaccttctgactttagtgtgaatgaaaacttcattactgtctctcctagtgcctattatctcctacaataaggatgtacgtttcaaat
taaaaaataccggtaa
atgcaagaaaaattgacttggtttcactgctgaattgggctaaaaaatcatttgaattgagcattcctataatagctttctgcatctcgatgcaatcta
cgcatcgttgatatgctcaaggatagtaaggtagaggcatttttatgcaataggagtgtcaataccaatcactctctcattttctcat
tcggtgattcaataggccaggaaccaattcaatgatgtctcgttttataggtacgggagactagaaagcgcataacaatacattgatacatgg
attctaatcgcaaatatcatatgcctattatcatcctgtgcttgtctttgtcttatattcgcacagggatactgttcaaagtgatgatgccgattcatacat
attgatctttgattatatgtccctatgatattttgcatatgtattcatcttaaacaatcgttttctgaaacctttcaggcagaagggaattt
cccatactccaactatcctgattatcgttcaactaatcctaaacatcatattggaccctatcatcatgaaggaccaagattcctttatttgactgaatttggaattaagga
gccgcttacgcagcgtcctatcctccttatacattcctgttgttgaaatattttaagttacctttccaaacttcctgatgtttatacactcctgagcttacactgtctt
gtactcaagttccgcagtcagctacatctgttgttggacaatggagagatcgaccgatattatactccgtgtcaaacaagataagtcattgctcaatgccctacc
tcattaatgtcatattgattgggacaatggagagatcgacgcaattatatatcgctgtcaaacaagataagtcattgctcaatgccctacc
aaaggctatgaagggattgatgagctagagcaggcattgttcttcttcgtgttgaaaactggcatttgccctattttt
gatagcagtctgcacactcgttatatatgattgttcttcttcttcgttagaaactggcatttgccctatttt | | |
| Contig55_gene_5 | 1367 | atgataaatagactaagaaaagacttggaagaataataaaactcatataatcttcctatattgaagtaattcttcttcttgcaatcaccaaac
atttgcggatcataatcccgactaaagctcgactttagaattgcaattgcaatttcatgcttatcaatattcaatattaaacgccctactacttgccaactactactt
acctacctaagatctcatatgctcgactagattcgaaccttctttaatagacgagtccttcttatataatcctaaacattgatgacgacta
gtgtccattaacgaatacatcttggaaaagaagagctagacaacgaagtgatacatagaacatcccaaaaggaggattcctattcctgaaacattgatgatgat
tacttatctatcgaatcatcttggaaagagctagacaacgagaatatgcctacccaccctcaaatcatgattgacaagagcagccacagattgatctcttgg
gaaaccgatctttcaagcagccagacaagctcatcctcaaacgaaggacagattctccatgaaacaataacaacatacctgcattccgatggttgaaaagga
tcatgaaaacagaatcatctcctcaaacgaaggacagattctccatgaaattgattgaaaaagaatatccaatgaaaagcttattgtcattaaatg
gagcaagaagcaatctgttctcaggagtgccaaggacatgtcaagaaaattgcaagagctgattcagcagatcaagaagcatcaattcaaacagc
tggttttatctttattcaactccctatgtaattgcaagaggattgcaagaagatttgcacatgatttatgaactgttatcaagagtcaggca
tctgtttcaagaacattcagctcgcctgcctcaagaaagatttagaaaagatttatttaaagtgaaatgagttgaagtattaacagtatattatattaatga | | |
| Contig55_gene_10 | 1368 | atgagtcaagcaagaaaattagaaaagactttagaaaagatgtatccagtgtatcagtaaagcttatttaagtgaaatgagttgaagtattaacagtatattatattaatga
aaccaagttcaatgaaattgactgatagcgattcctaattttctttgaacgcggttcattctgaatctaagtcttctatattaagttaatattgaaaa
aacaaatgaaggtgatatgcaaatagaaatctcaaacaatcaaaagacgtcaaaacagttcaataacaatcatacaaaaacattatag | | |
| Contig55_gene_14 | 1369 | atgaaagatacatatgtctattttccaatcctgtctgaatatgttggatctacaggaatattcgttgaacattgactgaaacgaataga
ttctacaacattgcttttctctgcgttttcaatgcaatataattttatatgctaactgtcttaactgcttaaaaaatgctataaaagtgtcta
aggagatatttccactattctaatatgtgattatgcatacttgattaaacctatcataaataatcaatgaagatagctccgctaaagtaattccat
gctcagttctcttaagcactgccctgtatttgtagtgattatgacgactacttgacaacatagcagcattgcaagcattgcattgtgtcccctt
aattctagtgattatcgatctatacaatctatacaatcgtttacaaacctttgacaaatcgaaagctttgtttttgacaaatcgaaagctttgttttgacaaatcgaaagctttgttt
ctgcaatatttgggcaatctatacaatcgtttacaaacctttgacaaatcaatcgaaagcttttgttttgacaaatcgaaagctttgttttgacaaatcgaaagctttgttt
attacaatcgttacaatccggccaataatccggccaataatccggccaataatccggccaataatccggccaataatccggccaataatccggccaataatccg | | |

FIG. 9B-261

| | | |
|---|---|---|
| Contig55_gene_27 | 1370 | ttcattgatttcatttgctctgccgtatatctcttattacaatatcctaaaccatttgatgcaggaactgtgtgattctatcctgagagc
ctgtagctgccctcgtctttggtgcaatagttttataatgagattccaagcccattgatgttttgtggaataattataacaattattgcattgata
agcttgagtagaaaatagagatgaaaagtgaataa |
| Contig55_gene_29 | 1371 | atgcacttattatgttttatgtagctatcgtacttgccataagtgatgaaatccatagcagaatagtatgggctatgtcagagactttacat
agtttttggcggaatcataagcagttctcctagattctgtaatgaaactggattgtccatgaaggattagaagcattattccatatgatattcg
tatcaatagtcttccttcattaaaataggattttttagcggctttaatccattcctattagatgtaagtcattcaatcgtcataagacatatg
ccatggttacctcataagcattgcactttgttcattgaatgttttattcttttatagccgtatttggattatag
atgaagcatagattaaatttagataataaagaccaaattatatttgttgaaagaaataattaaaattatgattctagaaatccaaagtat
attagcatcctatgcattaaaaactaaatagaacaatatttactttaaaattatatttataagtatgttcctgaattgacattcattca
tttaaaacgagctaaatccaaaaaagaacctcgcaaatactcttaatatttctgaagtttgactgcagatcaagtttataaatttttcagaa
ataactctgaaaactctataaaatgtttaaacagaatcttaaaactaaggatatggtaaaagaagaaaaagactttattgttgatgc
gaccccagtggacgtagatattaattccacagaataaaaagactaaagaacatctgaaaatgaacatctcaaatgagttattcatcctcta
aaggttattattggattaaagcaactgttgtattagattatgatctctgatcctgtttgtatttgtagtccactctgagctccaaacgat
gcaaaacttttcgaagaaattttagaaaaacctttcaaaaaagacgaataatcagaaaaggagacacattctttgtatttgataaggatatttacaccta
taaaactaccaaatcggaatcagcaaataacaaacaaagaataatagaaaagattatacaacagttaaaaatgaattaatgaaaaaatagat
cttatccactagccgtatttaaccaaccaataagggcaaaatagaagattttttcaaattattaaaacaaggcttgaatatgagagaaatccacaatatac
tcatgggaaaaaatttaaaccaatcagtttatctcaaatgtattttgggagcactgattatatcacaaggatttact
tccaaatcagtagaaaaaccgtttatctaaatgtattttgggagcactgattatatcacaaggatttact |
| Contig55_gene_41 | 1372 | atgactactgttgtatatacagttcaaatttccaaatgctgttctactcatgctgttctactcatgtataattttatatgaaaaggagtaatttctgagga
aagatttggaagaaaaaggaattattacaactcttttttaa |
| Contig55_gene_43 | 1373 | atgagaaaggaacgtattaaatcctatttgggaattatatttgatctttttgtaatttagactgattctaatatttatctctttgcctataca
aggcttcacttgattgactatgcaggttttgtaaggcttttgacttaacaatctgttttctcctatttaatgaattctttttatgattatata
aatcagatgctaaagccaaatatttcaaagaacattcctagattctaataccattcgattaatcgtattgccttattcggttca
agttccattactacttaattggctcgttcttacgtttggtcagagtcgtcagagtgttagggctgtaaatatagtaaaaaatatgttgga
aaaggttattaggctactcatgcagataagtatttattgtcatagcgttatagttgtcatattgttcatattctcttaactcttttccgtcatg
aaaacatatccgacagtttttatttgttgtgatcacctaaccactgtaggctatggcaatgaaggtttaatgagcctttagcgaaatttgtg
acattattttaattattgtcggtgtattggtctcagtactactcactggtaccctcattcctcttttatagataagatgctggaagaggcat
cagtgtgatgagaactctaattacattcataaatcaaaagttaaacttccatgaaagggaaatgaaaaaacaagaaaaagaattggctgctaaaa
aggaattggaaagtctaatgagaagtcgtaatctgagaattcagaagaattcaagaagaattctaatcgaattaataagaaataataagtaa |

FIG. 9C-262

**ORFs containing membrane-spanning domains identified from *M. ruminantium*: amino acid sequences**

| ORF | SEQ ID No. | Amino acid sequence |
|---|---|---|
| Contig40_gene_28 | 332 | mkveimiigilllsnflyhhedgnpivqyvayiasllviilgff |
| Contig40_gene_32 | 333 | meksvillaavvsfvtaflanisvalpliarelamsniiqnwvatiyllpiamlsiplgkltskhglnksllagiiltiigviiacfsinsel<br>lllsrviqgigtalinvasmalivsavnpetrgqalglniagvyiglssapvigglviyhlgwqsifyimliplifsaylswslkdewtmydg<br>piditgsiifsigillviygftivntwlgivlliigllllliafayfelrvnnpvfdvrlfknsrfsssniaslisytatfvityiltyhfqyi<br>mgfdskfsgmllivtpvmmailaplsgrlsdridpqklaaigmgfvtvaltilcflnestplymillamflqgigyglfsspntnaimssvpk<br>eetssasaslaavrvigqtlslgmltvifayimgnvaivpeyypllmessrlsciisavlcviavvaslvglrsddeyet |
| Contig40_gene_33 | 334 | mnskqktliilslslillasiaavsavdytltnadmdyvvksngllhvheaitydfdsspngvyrdiplksgqsienlevyvdgayaeyqiip<br>kgsgerikvylytdsskshklssdsvitvhyvydmpkvvkiyndigelqykvwgdewdedlenlqstitfpddeelqfwinpyfsnakarwae<br>dhlkihsdfvgdgkyvearaliplsefdsnaeyaqhinkngkdeiikiqdddkksqegfkslfsilnkvlvvlcfipgliylkfgrepkttyd<br>aiyehepptddppayvngmigsglkdvgslnqeafqatimdlinrgkmgvsseedteftkttfltikdtsglkrfeadvinilkryelngnis<br>lsymqdclrgesearyfqgrfeswkenfeneyfsedsfsrlfdkkgndylnyfaflliilgiiafvasiffdfavtgstifvgvllvivgvvc<br>lmlpsgiagkytdegklyeekwmkfkkylqdyslikehppesiviwnkylvyatalgvadevykamkmevysgsddyyrtndlymfyylgghr<br>findsfntasstisaadnssvggigggsgggggaf |
| Contig40_gene_36 | 335 | mnnkqktlailillaivltsisaasavdykitnadvhldvedngilhvsenitylfksdghgvyrviplkadekmsyltvdvdgsyfeyniin<br>rsgekevrvylykdkdltdygvsegstvtlkldyymenvvklfrdtglleyklwgeewdqgvehlnakvtfpndeeieywinddsgktessfs<br>gdtlyvkgsdipkgdyvearvliplgefdfdadyalhynhdasdevkkqqedfqkkqqyfntignllnviygililtplgiylkygrepkvss<br>daiyehepptddspafvnammsglskdvgkvdkkgfqatimdlinrdklgmeiaytnkkrpvslltvkstdglkdfemelidilrryeqngki<br>nflymqqqlsnrneayhfnrafnrwvsnfkvdylpddvlsryfntkgsdligkfkwialvagftgiiglllltgswiplvlglilifvgvicfy<br>lpssiggqytkegreyqqkwkrfekylkdfslikehppesvaiwneylvyatalgvadkvykksmkmevydgladgsnfssndlfvfyhiggir<br>sldnsfvtvnniisadssssggiggigggsgggggaf |
| Contig40_gene_37 | 336 | mnlkqkaiimlilsillmsaisasdykgsymdyvhmnvnenglvhvnesftyqmvspeseislplyhgtnasienihirvndllvaydlkkgd<br>tldelvihpkssdydydsestgtylldveveydienavkvyndvgaftyqinktdfngvslgmahirikfpgtqeheyfiipkegessaqwde<br>dhfhmtnsqpakatviipldeldadakyaqhidsdgleaikndsfdlkysliqivnilikifviiafilpvaiylkygrepkvtldsiyehep<br>ptddppffvnaimggtfrdvglvdtkafqatimdlinrgklsveteineknkqrtylvakstdgladyesdlisilrryeedgridlkhmels<br>lysksearyfrgrfnswghllysnyltddikaeyfedkgsklfkffaygglilsvilflyclmfnqmeplpwvialfilssvlicipsafagh<br>ytkkgkifkerwnnfkkylkdfsmmeeyppesvavwnkylvyatalgvadkvsntmkinfydglndetyrdndvfvfcdgngldligdsfsav<br>sttldsdsggsdgvgggsgggggaf |

FIG. 9C-263

| | | |
|---|---|---|
| Contig40_gene_42 | 337 | mnitenqsdndekiltksfclifgalifftalvmyalmstvteyassmgstatiaglvsgiyvfgglcsriysanalekkdwktlaliflsihf lacilyffvdnvellilvrfihglgfgasanaivtiassilpkkrfgeafgyfmlgttiavglgpyisgffydiwgsffllatvsfialv cvffldieryhpdekinnedilsdaesvgtesidanpikkqkekrsfiekifeidaipvslftaltalgvsilsfyrlyaveldvgpfsif fliysvilvasrpiagkiqdkngdkiicvigivaqsiglfliayapsdityicavcaalgfgtlnsacttivtrncsidrrpyaistfffc dstigfgpallgcfvsatsgyapiyyisafitlmalpiclyslrnk |
| Contig40_gene_43 | 338 | mgekaqwdsslsfifamigaavglniwrfsyvlysnggsffipyfvaiaimgipfllleygvgfsfkdsftnilkkidgrleivawililf vfiviyymvilswdmvylltsftfgwgvdtaayftntvggsadlakggifliptticvlmivlwfishrdvdkgigkvskvlipslfvim giivfysitlpghmigidallrpnwrmlldvniwlaafaqiifslsmgqaialtyasylpessrltdnvlivvasnsifeiftafgvfsilgy mslnsgmalnklvtegtglvfivfpmifnvmgtvgrvlaplflfailfagitsalgffepmlssasskfnlsrkrtatilsiigcafsilltt gissylvgvidsfvnqfgillligvqciifawvygidhfipvlnengilkvgkiwkfiikyllpvvlfviwaygiftlfttaktfeimvdiii ivavlilsfilshlnprgsnedna |
| Contig40_gene_47 | 339 | mkenkemnwkikfaiimfvlavliflarylicgdgeeiaylwkhigfipidilivalveeimgrkeheailekidmlmgtffseigndlia elskanvnkantddlkaikswndkdydnklkelknnpvdfkaniapeeredflnriqsllvenreflvnlinnpnllekdefsslllallhld eelarrgeltdikdadfnhlngdmkrvysklvyewvyylkylnkhypymislairtnpfdseadvhvte |
| Contig40_gene_60 | 340 | mieelvtnmsitesgasasspifititlvftilliligiiyfvfkmyeqskptvesivliavltaiatvgrliilmsipavnlasfviimgvvf gkeegflvgaltafvsgifmgmgywvifqmlawglmgasagylasrfdslprfifgllwgflygwitdisaifysgtalqitpiialyingf tydlthgvtnavllvlydwfkkmftrakikylsnpsssdesidltn |
| Contig40_gene_62 | 341 | meltaihpgvylyyfimvllafisdpyfvlsflalilililalqgvsselknimkffiplsvliiilnpllnrtgahriylfngffityeai aygilmslallivilvfssynrsvsyqemlyifskklpiismiivmalrfiplinsraievqklnnlkangvesdeedlnddsledlnseen nlsdennskedsdsldleqfdsnissldigsdsrvfkkikskrfqsiakeakvlgkimgitvswsleesmftaksmkargynsnertsylsy kfgladiiflalilivtvsilivigliqgygminiypsidfsfsdlpfniyyfafivfllplilyleikerflwr |
| Contig40_gene_74 | 342 | nmdlisgiiylilifiiimvfafsmgilspyvgrreilisilaigfvlgaiggyffilypmyqdspyvlgniqglftmeseininipstsnisdv tekilnqngvnsvstngfelttssinnetktyidsylkndsqierysigtnnisvdlkndasstatigslvtwlsntvgvssefavhikvnv nanqvldikeylrdnhytivsvegpvqdtihyfydhlapdyvvmcitgligvlvaiagiyvepltkfvrafrrgg |
| Contig40_gene_76 | 343 | msgfimvfftllanyydlkygiipnklsvflmtfgilinvliliivlnnrlyaifysylliifiisfvlwkisfwggdlkifcsigfslpf idilnhfytgsilnsfsnsqiillypkifsilinsilsfpvillivkllrenklnlilfasnmkllikelstktvfindlkegmivedy yfnslelfnlmeeltgneecynlkasgfkensyvlkssmagltrddikilnfaymetlinfpnfkikmgvpfvpsltvgylvflafgdlvfl istii |
| Contig40_gene_127 | 344 | msdknewgsnlsfvlamvgsavglniwrypyPvvlysnggafyipivaillmgipflileygvgynfkssfpkairkisskaeylgwllpts vfiimiyyscilgwdgiyvilsffkgwgadpntffastilqssesvsgitnfipviaivmliswgivwyishkdleeglgrvskilvplifii miviviflsltlpgamiginelfspdwnlildfniwmaafgqiifslslgmsiaftyasytgkegdiitntlaitfancafenfcalgvfsilg ymslqsgtavadivtqgtglvfvayptvlnvlgqyayvigplfitvylagltslstieplsfsiqnkftwsrkktmtvlcligavlsmmya tayggtllgyvdayinqiailfgvileciivfawifkcenipilnersktikigkwwvvivkylilpfitivwggvldtindgstdqlivfg iltvillgitalftlhipatneewdeteyrl |
| Contig40_ | 345 | midsfryalngiavsikdernlkiqmivmmlviiagfllkisrtewiicilifalvisaemintaienaidytremtvdkdndlariakdvsa |

FIG. 9C-264

| | | |
|---|---|---|
| gene_131 | | gavlviaiasaivglliifipkvllll |
| Contig40_gene_145 | 346 | miwrekslkdvleiafaplffwllieigfalfvslfigvflidmiigieamv |
| Contig40_gene_168 | 347 | mvvlsagdtawvliatilvllmsipevaffysgltkrknvlntmfltfiafsiasiiwvvygypfafgdvsisgliaqpahffmsgigiedlt<br>gtiptilfivfqltfagltaalisgsivgrmkvsawivfiiawvtlvyvpiahwvwgggflmqmgsldfaggtvvhinsgvtalalalvlgrr<br>kdtsllphnlgysvlgagflwfgwmgfnggsalaanglaasailvsnvaaatalitwviidivkvgkptmlgaitgvaglvaitpaagfvdv<br>paaivgfvttfvsyfaiyklktrfgyddaldvfgvhglsgiwgaiatgifavpavggaagllygnpgqvtiqvisvitvyaftisfilak<br>illdktmgirvdekteieglddtkihkesgyrl |
| Contig40_gene_173 | 348 | mnilnlpliniligngisffasialilscvvndkreaykyqviealiltvssafflswtgiltmliaaarnylvmnerlssrlaiifiiitlii<br>cplintmgliglpmigiigllticnyylktikwikvafivnvliyavyfigiydlvscatqvitaliigfislvkllkdekegnidsqpnn |
| Contig40_gene_174 | 349 | msddelyrraerkvdekigfykhlysyigvnillfainaitsfgkwwfywvtifwgigivihflktfvltgklednreemiqkemekmkk |
| Contig40_gene_175 | 350 | mkrlfklvekyffiiiiavaiavvfpgsfdwvmgefmginininillgiiilfgmgttlkienfvnvfkrpkeillgvgaqyiimplvaigvas<br>lfglnealtvglvlvlgtvpggtasdvitflakgdlalsvsltavstvispiltplitlliligniafnpvdmfisivgivilpiaigllnyk<br>fpdfceelkdylpavsslviaiivagvigankgailgssvviiaaivvqyfiamligfvigylsgmrkqmvtiaielafqnsglststlakth<br>fpalslatvpgalyswqnfagsilayifrkyftdee |
| Contig40_gene_176 | 351 | mneehynkqllrdyqestdlsvydhreeidydedvdislcgcpdcaddhdhnhehshehshehgh<br>ehgdehshehshdhdhghdhehehgdehshehshdhehesedtcgcgcdddcdhddleehshehdhsdhhehdhhehehdhhshehede<br>hhhneehshehshehdhdhehdhshdhdhghdhshhdhdhgdscgcgedhdddfslcacpdcaddddhgqeellaegkpli<br>ynrpiqimvssgilfitghileflsfsptivtiiymlgaliagyeialiayksIvkrhtvgpallvviaciasfiighgeegavallyyiae<br>fledlaehrakrsiksIveiapetarvkvgdgeesrrieevkvgeivlvkpgdkvpldgevvygtssinqasitgesIpvtktvgdevfsgtv<br>nedgylevvvtkeakdsvinkivtlvkrsqlnrsttetmvekiskyytplmiiiaacvafvpplvfgqdlidwiykalsimviscpcaflist<br>pigmvsaitsatkkgvlikgstyveemrnvkavifdktgtltegklelndiniindeyseeivriaaslensshpiagaivnyanekeigf<br>eeiedfrnvpgkgiigniggkqyyaaneslliegsqfnisqeeingysaegktllfigdeqsviasitvmdrirdnasevikdlksggvktfml<br>tgdnkiaagkvadeigldyvysnllpedkinildtlrnkfgdvamvgdgindapalaranigiamgaagsdvaietadvalmqddisklpylf<br>slsqktmniikqnitlaivvkalfvilailglitilmmsvgigdlgltlvvilnsfriamvkdplf |
| Contig40_gene_183 | 352 | msesitpnggakysnnknkalaskkgndsyyknvlligspnvgksltfnkltgmtamvsnypgttvdidegnftyenktvhitdppglydlnt<br>iteeervakllvldkrfdlmvhvvdaknieksidltlqlidagkevilvlnmmdelekmgatvdapslshelgipvvltaaaqnrglddlkht<br>ivnydsienqilsesktlldvdygrsieiaiseiqrnikgnypvskrylavsllegdedsedllmesedwdnlsqvigaqkakfdqpvkyltk<br>lrladyakhikssfttidsvniqdtdslgeklsriminhpfygllilacvlffglylivgvlgagilvdflentifgqyinpavtsvvvqyipw<br>vpiqnlfvgeygivtlgltygfgiilpivslffivfsiledsgylprlallvdngfkriglsgrsvipfvlavgcgsmatmvtrtletkrern<br>iatmlmaltipcsaqlgvimallsarprsiwlwlavivfnfvviglyakrfvpgaqpsffmelpplrwpklshiakktwtrlvmyikelipif<br>ilisviiwaldlvgifqwiiacvtpivnaiglpgstsssfvlgffrrdfgaaglmtiqnqltgvqllvasvtltlflpcvaqlmimikergvk<br>lagliavmsivlafsmgfivnfiltslnvvl |

FIG. 9C-265

| | | |
|---|---|---|
| Contig40_gene_188 | 353 | mivgilsiilaivvyfitppyiefylifvflipaialivpndaiknsraigaltfilviivayfaisgmlgaydvltnmyvnglinstpstsd isacsngylmvllyalfnifcgalffkrtssiddvddedaf |
| Contig40_gene_215 | 354 | mascnigkkfiaeligtfflvffgtgaavtllisdsvtpgkagiglglglgdwiaialafgltvmaciylfgkisgahlnpavtigllaskn isaidsiyyivaqvigaclgsllyvclgaqavtigglgatapgmgvgylpaliaecigtfflmlvvmgvavdekaepgfagisigmtvaavi ivlgaftgasinpartfgpylmdtllggtnfwgffpylylgpivgavlaailgyylakgndacalpqpffee |
| Contig40_gene_218 | 355 | mylgssfafiapmvagyaiggkssifsalmvglvyyaiaiiiratgkewinkllppvivgpmimviglclaptaiqeigldqavvpinniiv alaaflttaviairgkgvlkvipfligiivayvvaallgmvdfsgffsaslfevpefympfinysfnptalltivpialvtmvehvgdhkvlg eiigrdliqdpglnktlliggdglatffaallggpanttygentsvvgltrvasiyviglatvfavifafsghltallaampnpviggvaillyg fiavngvkliiqeevdfnnnknivvaatmlviglggatlsvaggdlsvsisgmalaaiagvilnliiperkednkfvpevk |
| Contig40_gene_220 | 356 | myiksffndinltkkdgiyllaltvfsilytvhlidvnytlnfksdpfvylinglvyagmghienysygmfltpvvsfltslifrmgivdki aimivsgvisilgeiglyllfktkfnevysffgcilfasfhivltiwgggidipvcafsiitflfmvlavdknpkyyiptsiflliisiftky dalfiipilfylytkhdffnlvdlalsdrdelkivikknyikseefkyivisliiavvlfilfceviwsyganltfltqsqeslngfnsakaa rshfyndkkfyirnlytffypqisqefsliipaiiaigtvfnfaniirrrkeypmvrdyktphfkyllvgliiilipiaiigfkyishmvtn valltlicvcllsladkfdidkrtfnldifflawiffvfavffsfitikgqryliialpavvyfvirtieeifnkfkdsnilkitliiiaaiiiv yslsftftdgnfdternntaigevydylveydpdylnknlssdysygsrfgtwtlkkdvryvklgvidqsesdylivkhdnvslanyteiyra gkiklyqnnmydnssi |
| Contig40_gene_230 | 357 | maailcprcgkmndgsldfciycgtyfddyneednndnlffirsmtndgrpgkkqvvrlnempdnlqkpkhrlaillgylfailgglgfvfa lylitrkdknarrhgliqlvillieyaligvlilnggldinmvldpfnmtrmnnitqlynssqmnvsgsnisslfgf |
| Contig40_gene_246 | 358 | meelyymiyiivfivgsilglliilsykkhmepfiiseidvltlviavgwfllnhgligfvssvilltiaffciglaigrrpgygrketaigi lvavivwiltsgvifkf |
| Contig40_gene_247 | 359 | mnlmaqilinvviaflagsllgfhrkvmarvqlrpgppiiqyllhslkfffketsfpktasmpfyvgitvilagiwvtgvivgpvckgslmi ifgiyaihkivehnagsssgspygklscvravfsaagelplfaviavvfllttgtmdiggiiqyqaangplafkiplaaimfftlivtkspysp faitkgkeiitgfetehfgmlrgyimfsesiawyillwlfltiffapigvvygyligmilicvitgfinattpmlnpnhsvmaqisiavcvvg siimiii |
| Contig40_gene_249 | 360 | mlienlggdflgtiplgdivlylnplhihifvftilliftaliaisrtetqveamfgsldenkvavglkefkhrrflailcgiatagamitgdlf nftlfmaligivnigivsavkqvevlnsayqygliammcglplfggaaiilaatgtlslfelasipanpmmifgalvmligvcgesglapffa skaemfrtpgspfiliiihlsslfliivrfieiltil |
| Contig40_gene_250 | 361 | mvasvipqvvpafyssmyttalygglivafigligvamekrdiqilliltdivglamlivvaavgtdlsealilpglvvelaeimaiseilisr emrkadkdtsfspmpldidmeimttapnfialllligygiflsgftggavagggivivylsrkvrglpifvldgvgaisgswclwiigfifff ilpqywllslflaalgllllkvaskigligilmreeygrk |
| Contig40_gene_253 | 362 | mlefinietismalmliigaigvvllkkpldkiimvsvleaglflaivsfkyldvafltavldplsiivfllalikinkvrkskledystldkl nistenleeksldknseggk |
| Contig40_gene_254 | 363 | myieligvitilmalravitknraekllyinvigfcvsaiialyikttfgfvlaaffisstigsnaiayslkdledeisydkdmeerdeen |

FIG. 9C-266

| | | |
|---|---|---|
| Contig40_gene_255 | 364 | mdmiigiilaaviswinfvvvdtflglpeapgvkgaetvgysikerkgdlaggffqnilcspdasagtliaaigvyalgigqgliaallvyi gnrlcadpgyagtcgaltmtllifisfvgievemficgmviaiftiggihhptssrllgkiaksfgrytkye |
| Contig40_gene_256 | 365 | maivvailafalrlpllperpirfswttsalfptpifaigilaifyslnvywiydglilsvivglasalfvkygfdyifpkppqiedggnv |
| Contig40_gene_268 | 366 | meidelityliiiavvailikifswllpifvilavayvlylyitenna |
| Contig40_gene_273 | 367 | mkkiiekhygihlnpndflpieeiksimqlyflliilllyicimnffnfgisgelifinslidiiilsvflvtiyydgstrgkiisifllpi vsisyilfggsliryrdfiripillylvvifynkfidyternigktlilllsiiytgillltivlekqnpidavamvtnaitsnqyaalqdse ggvltsvflawggyiisgvvatlaadiihrnsrkkfrnmetkidnlenkidnleriivesqkenee |
| Contig40_gene_282 | 368 | msfltlilknpfrsksrailaligigigiatlialgaitdgmiasaddtlhaggcdftvsgkiestssqmatfgtstidedyidkianvtgvk daigmymtvlmttnspyfavvgldpedyqvsdltitegrmykndtneivigkiaseneekgvgdtitlddkkfkivgiyesgntlqdqgfta iknsqklskdegkissiyiknndgedvdkvrdritdkygdnlttisslsdlemtknmidmlngaslaislialiigavgiintmltsvfertr elgvlkavgwsdekilimivgesivitivagiigsivgvigvellaaskimqllnpvysvdifvkafaialfvgliggiypalksh |
| Contig40_gene_284 | 369 | mqtnkniesiigdpkkainrltyptilsmllmfannlidsmwvsglgaeplaalgfmsplylviigfssgvgaganslisrligakrydesnn aaihsiiialivsiiisiigmffldd1lvlfgagsvldyamdygmiiflssiilfpaivsslfraegdirratvplvvnailniifdpifiy ifnwgvkgaaiatvlstlvnlimmlywylvkrdtfiklsleyfhskmeiykeilfvsipasleelliysivaicfnylimitagtmevavftvv wrfvsiaflpcisigistitvagiaygarnyenfkttinystflsftitliliciifffvfaypisetfnfisgdaemisrtaevlrimvfyniv ipfggtavyvqaiqsgfkslaitilrelilsvflayl fgivlkmgifgvylgaivgmaigcfigftcikiyqgkfkkeces lnqpv |
| Contig40_gene_287 | 370 | mfgkdkkensnekvlyegqpnlivyskifiavillgflfflystgiqyignmqvymiestklpltryfaiavfviimvvilyiiikfswts ikytitesrvivekgiifnkknympfntiqdvsrsqsilgkafsvgtitlysaydgkdmslkdvsnpkkiedlifenmrtthlrshnlyddsy gnpynnsynhnnhwgydnygdsyqnrdfkpirpnsdekvhynmedlddielvdvkerkrnlreirrkaknsrgnnynnqpidgpsnnynrn snydpnynrnsnykqnpnynrnnyddfgydyesgynqrskrapqgnrgyskrnanqyrddsranhqretiresyqrnpnkyfaqnyekfh qdnleaqnrggesfnemnpldsndyygmdddfisdeefdstinkamenigdnikfkpnnhsrvvnshedfdsrvnshedfdsrmndsyddfa sgsrhntdyansnqnrhynsnypddrqfrsnqsyegdyrqsrnqsypegdyrqsrpnrsydygyhsgsnpnynnsydqsnygyddyrqsnnp prlnkqsssdnyhksnnrnrssnyrnrsynnqenynsnyndmednsnnyeesdkkgkkkknkdsndllekhsrkfrrs |
| Contig40_gene_290 | 371 | matfkgfamkrlneigwvekevpecgpmdaiikptcvspctsdihtwegaigdrrdmilgheavgevvegvsmvkkfkpgdrvivpaitpdw ddeaaqrgfpsqtteplggwkfsnfkdgvfgerfhvnadanltfipdglsdegacmltdmwstgmmgsenaniplggtvlvigigavglsai agakclgagrlfaagtrpisvevakkygatdiinykngpideqvreltdgagvdsvviagnlentwaeaiksakaggtvsnvnylsgadnvl iprvewgcgmsninitnglcpggavrmerladlalgcgrqdpellvthkfkglekiedalllmkdkpkdliikpvvmldid |
| Contig40_gene_301 | 372 | mlkqiirknftskykdsvlgilwsffnplitmalltailfssvfarnienfpvyfltgrcvidffnsgtkiamtslkknsgilnkifvpryvfa lggifsefinflmsmivlivimivtrapfhlyaifsvipialfililqvgltlsilctkftdieylykiftsllvyacaifypidivpqpir qymelnpiygiiaqfrefvmygrfpstklmlitfltsiviflgviiffkyqnritlel |
| Contig40_gene_326 | 373 | mgyltdlfkealvyplsnivtlliilgvltiiskfpnvlssfgvdvdfqliiifalisfvvslfmdgyslavikdavdfnvsmpafdimknfid gvkvwvlkilyyliptlitifvalltggvdailnifrfigenqellsnlntpaelinaipqeyiatfltslfitaivailylifgllynigl crlakydsfneginfkalindikaiglgtyilwyliilfllviinlfapfliflvnrslgllytkaegyng |

FIG. 9C-267

| | | |
|---|---|---|
| Contig40_gene_338 | 374 | medfkyyknkikeeiklafahnkyflivsalifiipmfvgyfysdqitpyiqpmvdtfeenirngtvtlstkslfannvevaiilyalsalga ilgivvlannglfigfyganfeltryvlltlphgifeisaiiiattggfvilsfvlnflynviypdysytdifdpyfsdakityvqrfkssfk khghrikesfilcvsvilliiaafieanitipfaywicslfgisli |
| Contig40_gene_356 | 375 | makrnfseslgkivtllkkdftdvftknpvpvivllalilipslyaliniqacwdpydntgnieiavanldngttfegeslvngneiedelkg nddfywfvnetelregvkngtyysgiiipknfsksiksittddphsaeleyivnrksnpmasklsdsaakavynkinakivqfinvvayskl gelqsalsgqagqmssgavqlssgsaqvnsgasqvksgsnqvksaanqvqsggaevqsgseeikshasevksganqvsggssqqiqa gssqvqssakqldssvdvdklpsddlkhvvnsskqlanassnlagsssqlangsvqlangsvqladgsvqladgsvrladgsvrlangsvqla dgsvqlaegslslaagsqllansaayalfaassslsgaaslssitgvdenqigsyiyspvtlneielnpvdnygsevapfylvlsmwvgali tcvmlrtgqstgteyspsemyfgklliifmvmavlettvtligasilgiemsnpvlfvisayfialvfmlicyslstalgqlgkgiavlwlvfq isqtggiypiglmqpilqavspympmthqitllreaalglvwsnyihsfliliamglitliliikvfadkrahwfeeklnetdlfh |
| Contig40_gene_366 | 376 | mtvsflfvngaasvllnaidkekavtkiyimavifnvclnlvlipmfsydgeaistvlsvkyllsf |
| Contig40_gene_368 | 377 | mnqiksifkntgwlsvsqvitsicaflwtiliarylgvsdygivsfavsftglmgivmdlgistyitreiakhkdlvrkyfnniflfklilai ilfilsglilyvmgyshltiivtlvftielifmsmttflngvfqafekvkyqaigailnssflligilitlgfdlgvisiafaytvaysiyfs ymflsyvktfsrphledtnfireviiksipfglitnffysiyfsidivmlsylagdyatglyksayniinvfttffvvyqsvifpvmskffke sqnlikvsyelsvkyllliiipisigiffyarpvdliysnqyslastpvqiliwtvsflfvngaavlinaidkektvtkiyliaaifnvcl nliliprfsydgaaiatvlseiliititlyhifktdykpdlglknviklivcgiilfevalyylnlslwfaipvgfivylislfitksiddnd ryvirelinr |
| Contig40_gene_378 | 378 | mtispkrilyldevrslaimlvvighlarlifsynynswlfcsgvfsltrigvplfftvsgslltrkyevkkflekrfkrvclpffswiiiyi vagvliwhydltfeyvvntafgvgdysalfwfiwsligvyllipvissfireegnwgaeylilitiilsllytfgffdypqmkynfrvifnff pvlgyfimgsyihnkkfkysdkkmfaigcvlfivgicghfakiylkglgslapidffdicvimetiglfiafkyastkwdkrkdarn |
| Contig40_gene_379 | 379 | mqeiefretklgevivlfascsfgiyfshyilmryimyngflapirkthalfwlpvssiiiiglswliiyvmskipyvriasqvk |
| Contig40_gene_387 | 380 | meigeiitdslkypinnikalliyiviglvivltgvgvgagaiansaaatgivgiigiiffliyllilgyeldvinfgierddapei dfarqitngikwyitcfiymlliptiimiilsylnqtlglivgiiilfiiiaafallmaqcrlahtdslgealnipeaikditkvgiikiiavfli lvilglvvsfilglfsvlgdvgtyigailsgiftiylafvvfrasgllysdav |
| Contig40_gene_401 | 381 | maqikcpdcgkeqedtnkfckncganlsnvkaeevkididaapteekididntapteekidintapteekldtdasevketpkapvenkkicskcghelnnekfc prcgqstasivpyeaktesqgenndktcpscgtkvttekfcpncqskieekkpvqtqnapqkycrncgnpidpkaeicpkcgvrqltvvkkep lfslilslifpglgcfynnqthkgifllligaivsivltifvigvllymlvwlygmydaysttialnngeyvedklf |
| Contig40_gene_428 | 382 | mqrktlsrfdeivklrkydmdkvlgqttrnrispfrsqsenkellkedfperlirtliqelgttfikfgqllstrpdlvgeriseelsqlhdd nppidfeeikvliiieedlggnlkdfftefsdtalatasiaqvheaklhsgervavkvqktnvqeivetdlnimkflanesdrfnttfkhlnlpa vvkefdrsihkemdfdnelmnirhlrdnfihndkiivptiypdysservltmeyvdgvklseviagddpkynkliladrmvrayfkqifldgf fhadphpgnifitdcnsicfidfgmmgvldenfrqdlaelmicfsnrdidglinqliymnilnvktdisilkgdlndlfakyygvelsrfngv iedllflmqkydvmlpnefvlmargslsmvenilgslsdpdidiveiikpfarkllmiqkynpkkmvhnarntfftvehmlralpslvsktfykvd egeltinievkqiseitngislaliliaalvigsslammveaqpklfgllplglgfvgftislalgvftvvryfmdf |

FIG. 9C-268

| | | |
|---|---|---|
| Contig40_gene_433 | 383 | maiimkhrlnldnkdpnyillkeifkimdsrksksilasygfknlnrtiftfkilifismffgidipfilnelkskkelrkyfnisevltadqv ykifseinseklikclnrilnsrnmvkrrgkktfivdatpvdldinfrrnkkskehlrklnlkwsyssskgyyigfkatvmcdysmnpvcil ihsgapndaglfeeilenlqkrriirkgdtlifdkgyyqyknyqigigkykivpfifpkekfnrtlrlddiltyplavfnktkkimeekrlynk lkkellekldswekfkpirgkiedffqiietrleyernpqiyskis |
| Contig40_gene_465 | 384 | malelmnllisilgavyfmlpayvanlsglafggtpidgganyrdgnriigngvtwkgcingtligtlvgvvlgivgmyygdlstltggvid lhvygslfsgliglflmafgalifgdavgsfikrrmnlqsggpapimdqldfvlgalifsllvvriswsffiiiclslilhlssntiayllgi kdvwy |
| Contig40_gene_471 | 385 | mfeftknelrdlviafivlsiafaianvkfdlhafisilpivmfgvgvgfllhelghkyvankygykaefklwpigllialitsligwvfalp geakitaenideettgkiaiagpmaniglglflfiviaaityplkssftlfeliylvstvgfsvnaflatfnilpfytldgtkvmkwsvkafiv afaiaaimmlssmfigaenmlmligs |
| Contig40_gene_475 | 386 | mglittgmeqsvqttmnegaaeitvtnitsigagtidsslvdelknitnvsrtagilsatdqnfvdmassndmssmesstrlyginradidle gikdingsffeegtkqaiigkqyaqmnnmsigdnisalgeefeivgvfetgvladsgvvysletldevtgaegkvnqvivktdegvndtvva daiedkyenlttitseemsqmldnvigildavsvavsalaiivgaigivntmvmsvyertkeigvlksvgwksrkilkmiigetlvltilsgi vgsafgiliaevgvrlmgdtdfalgyspstfimafgitivvgliggiypaykasklaptealrye |
| Contig40_gene_481 | 387 | mikkktndkeqwfiyranlrcktlviiglaaliliisifvcgyfirdiptnfasanqmpslehlfgtdwmgrdnfqrtiaglglsimvgfiasv lstiislvlglfssfnkfadeavagiidlfgsiphilliiivsimfgggvwvimgvlthwtplarvlrsevkeiktkeyialsenlgrnkv wiaikhifpliisqiivgvilmfphaimheaaitflgfglpphepaigvilaesmhylsagywwlafypgisllivvllfdligenveklinp etaqs |
| Contig40_gene_482 | 388 | mnkqkiakyfgwklvrfvvlmiavaifsfvlidlspidpvnaylkgaavteagrailqqyfgtnvplpekifhwlmdllqgnlgtsliyrrpv mdviidkfmaslalmtiswilsgiigfalgvvagknkgswidkavkvyycyaiqsapsfwvgmlismvfsvylgwfpigfgvpigvrstdatfi ewatrlviptltlsivglapiamytrnelvqvlssdyvlfaksrgekgwalikdhglrnimlpaitlqflsfselfggavmveqvfsypgigq tavaaglqndvplflgivvisaifvfvgnlladisyyfidprikenefnd |
| Contig40_gene_487 | 389 | mefiklkrskiflfllsvlmavlpallmyiatfafdevqafdalftnvnnymsvlfavlifaiimaylfgreynehtlkmmltipisrgkfllsc flifllwllvlsvlsclsslifgfaaglsgftvnllinsfaqllfanllfltfspfvfislfvtnmvpamvggaslt1vnmlvyggtwapyv pwvcpyliasgeiaeyginmllpyglvfatfivgivislyfftkkdvpl |
| Contig40_gene_495 | 390 | menhkaliaipilallsilalisfngieggvelkggslaelqltgstsvndlesqltkelntnnikvtsngenkvtvelennvnsstfskaid gkakvisyneigpvlseeamgqiyiamlfaflfmavtvfivfrepvpsvaiilaalcdilialgmsilhiplsiasvgallmligysvdtdi llttrllkrregtvderarnamhtgltmscaaiaamgilyivtviimpeattlsnisavlvigligdilstwlmnlgilktyidwrqskkqdk fnidapksnesksksskeedgksesksfkdrfkrskdddskdseseedsskdssndidsseeekssgkdkkssktksnkkgnkrktkks kkkgkggk |
| Contig40_gene_496 | 391 | masnlskffkdrqviilicliisisisflgveqgldlkggssiqlqlehpvndstmkvvtsvldkrlnlygvtdvkvrssgdqmvivemag kspeeverlignpgifeakidnktvlvgscvatvdapvvgesgewqvpftlttegakkfaelakgkgghevvmyldgkiddhppalaeelas geavtevqvtggaedvetakaesnevftvlktgslpvkihtvgsntvspelgqfaggaliagllailgisavvyiryrraflaipilittls eiiilgvasiihwnidlaaiagliasvgtgvddqiiitdevlhhddentrhrrtrtqmnvknalfiifasagtliaamlplayvgfargssy igtiagfafttiigvligvfitrpayakfielfvs |

FIG. 9C-269

| | | |
|---|---|---|
| Contig40_gene_498 | 392 | mwemvwpilllvilsntiynictkstpgnvnafgtlmityitaailtaiifvflvkpenvmvelshvnwtsvvlgiaivglelayifafragwk vssasivaniglaivlvfvgailygenitlkqlggificavglfflinmg |
| Contig40_gene_510 | 393 | mqeanedidlivnhpkqainklalpiifsnffmvlnniidgiwvagigsnslaavgfvtplffamvgfanglgaganslisrcigaenyqgag nsaihsmmlsilvtifativlilvflnplimimgageiieetsnygyiilvgaysiflpammaaifrsegeinrasyplmlnaiinmildpifi yvlgwgvkgaafatvlagtfatlpmvywmfikqdsflkiklseyktnlkiykdilvvgipasieqfiiisfvsilmnywltllagtlavaayta twrlvsigvspiligigvaaltvggaaygaknlknfktalnysailgliissiliicsiffvfaeqlsfiifsysadsailaprvvdalrilcffil lmplgvisgnlfqamgkgtislvltilrsfilevifagifafvfdwadigiytglvcgmmcgsivsylyinylkkhedyfivk |
| Contig40_gene_514 | 394 | mfigllapaivstvfimlsgsdllkkdfknkmigfykvkwlnviwavivfaiivvcsillsllfgqpidqfsftesfsftgviagafititl asiieevgwkgycedsignymnwfwesmifgvlwsfwhfplifisgtyqaglmvnplyvinffvsgipmgfivitwwylesdrsilacmifhff vnfmqekialtpetkcletivitvvailivmakkdmffetrhvgrlleynssgqq |
| Contig40_gene_526 | 395 | meesktrfegvesilgdpkkaiwklsiplliislfitslysvidavwvsslgadalagvfvspifialmgignglgagatsaiskyigegdkk ksdngavhaivitvvisifttllflliflrdillsmgasntidyamdygvilvsgsilvilsnslygvlrgegdgnrtmyamlfasilnmildp ifiyylglgvkgaaiatlisllifvnlllfywfyikkdtylrpflsnyrfckditvdilkvgfpaslelvnnalfaalfslllttvvastdavav ystgwrvvtiattpmlavgtalisvvaanygarryedillahrysmkiavlfgfiaaivvyfapqivsifaytgtsmrlssqliaflsvivi yfptmgygvtstflfqgtgngitamfqtilretvftlgfailiavvlgygeygawgiilgelvvntitmfwadwhvkrliirsnn |
| Contig40_gene_535 | 396 | maginlidsvmyypilllivmaiaglyftfktrgvqirlflesiriltepppdeegsisslqamlvstasrvgtgniigvstalclggpgacfwm wvmciigassafmestlaqiykrkdkegvfyggpayyiehglhkhklallfcvfllatyavgfnmlcsfnlqstfmeypfyhpsitpiiigav laiitcycllggkrivsvtstlvpvmgvsyviicllivilfniqnvpvmfllifrdafdfgsilggvagscmvygikrglysneagvgsapna sasadvshpakqglaqtlsvyidtlllctasalmclstgvvrdaavsgapyvqnaissvfgwigpifitvamilfaftslignlyytnnvlmf mnnekmpskrfyhifhiacsliifigailipmdaawamaditmggmtlinlpvcllisikaaidclkdyerqkkmglkpvfkassiglneeeldw wk |
| Contig40_gene_541 | 397 | mnvfrsfidilsdrtvnergyffsnkalfalfliplliveqalefcvgladsmnvaslgevaisgvslvdflvqllilfsfsalatggaviaggyl gndepekaccdasnqlvwfttilavimavlvlifrpflinlfffgqiepdvfntssiylsymaisipfialynsgaaifrtmnkanlpmqimfvc dilnvignaillfvfgfgvegvaiptvlaralaavimiyfvlqeryeihirktlrhkfdwvllrkvlnvgipygvengvfqlgrillilslvst fgtiaiaansvgyaigifsvlpgfainlgltavisrcvghndyeqakfynkkilitttflshlainllifallpyilqiynlspaasaltyqmv vwhgifavliwpiaftlpttfrgagdakwpmavslsvmficrialsyviadfmgvgvfgtwiamfidwyvraafyvryfsgkwmeyravgtn ls |
| Contig40_gene_544 | 398 | mrtlewednklklidqtklpdeltyvcsnykqvitaikdmivrgapaigvsaafgmalaglagedmekvavemknarptavnlmwavdrvmk aenmldealemaredintnlaigeygaeliddgdtvlthcnagalacvdygtalgvfrsafnggkniqvicdetrpggaslswemqqegi pvklipdvasgylmsigkidkvvigadrvahdgiankigsfmvalaakrfdipfyvaapistfdkeisifdteieerdpneviyggaricpe gtevinpafcdivpkdlitgvitekgvfdlnmlekdfkelf |
| Contig40_gene_552 | 399 | mllskileellwgmgtsieiflltllfsiplglavaagrmssfkplqwfmkayisinrgtplmlqlivffgpyyifgmtlsrdyrmiavila ftinyaayfaeifrggiesipnggyeaaqvlgytrvqtffiiilpqvvkivlpsitnevitlvkdtslsfviaipemftvakqiaaaeasisa lliaggfyvfvnalvaiimerfekrldyyct |
| Contig40_gene_561 | 400 | mmvfgiedpwiwgvvlligmtlvcvaygalnwnned |

FIG. 9C-270

| | |
|---|---|
| Contig40_gene_562 | 401 | mvgyvgylawkrtnssedflvagrethpyimalsygatfistaaivgfggvagkygmgilwlaflnilvgifiafvffgkrtrkmgknlnslt<br>fpeflgrrfdskfiqyfsgvlifcampiyaavvligaarfmesslmldfnlalfilavvicgyvlfgglkgvmytdalqgtimfigmlillvf<br>iywvlggvteantaltnmahlyppdalaeggtgwtsfpklgspfwwtlvttiimgvgigalaqpqlavrfmtvksnkelhrslligavfiavm<br>tgtayivgslcnvyfyqnfgqiaidyvggnmdsiiptfistalpewfvyiflsllaaamstlssqyhtggtalghdivdafknrgttreytd<br>eeilegssketrigfisvsqlgiliavvlslliiglilpggivalgtslfmglcaaaflpvycaalfwkratrkgaiagllsgtftslfllvf<br>vykktavglgickaltgmdmlinvmpwysidvmvfaipvsviftvvvslIsppmdekvikrsfeglsee |
| Contig40_gene_565 | 402 | mldrlksislgnwiligmvlglitgviInlyvhsqfidiIildnvfylggnifiklmkmlvvplvfcsivvgvasisdirkigtiggrtliiy<br>littalavsialliasfihpgaglhmaglatasnvstnvtitntilgmvpdnpinslangdmlpviifgvlvgiilaklkeetetinkvfeeg<br>ntimmentsivmkfapigvfclmaktfatlgfdglmplskyvicvliglavqafivypslmviftrlnpikffkkfysvmlfafssstsnati<br>plnleklselgvsrevssftiplgatinmdgtaimqgvavmfaaqaygmdlgasalltviftavmasigtagvpsvglitlnmvftsiglpvd<br>aigliimgidhildmfrtavnvtgdaictiivsfknksidldvfngkkqaegss |
| Contig40_gene_570 | 403 | mfldrfslerndlnfrkynlailiaslllylIniyflssfgdffkfyfddifaimvlfsflnlvfpykidnfwiiviitifaaffweyvalfi<br>kpgsvfdyldilayflsmviylililiyafegelnvsf |
| Contig40_gene_571 | 404 | medevidvedyevketaivvsddeedndysksssndnnytsnttfrtatislsnekliilalvaivliaiflltfc |
| Contig40_gene_574 | 405 | mvlicpilaeeahattvflitsdnvlghdedmqmlndikgqietksngqitvivdenasnpgegtramnadcdiavtiayacagnlvdlgsysv<br>qstkkiiyvnagsldltsinflrrsyddnwsssfaslqnpgqylydsgitllqpgqkfygetdngnldhcsseidgyiadevmkqvysngvi<br>rkldsdyinrhkldpkylaedskkivdgfgtpmadsygsyttqqllymsaasylvgysldvpqfappenpaeysaftkgtysfneycemadiv<br>vdymnehgkapdsisykgatisyydlvynfalltqddfdaahmnfpqnadfgkynsnildlilpiaiiiviiavaliirklikkgrrgikri<br>knrgkdnnyyrngasgnrsrksrggsrdnysrnsarynnsrgnqsrksrnsgrprnsrnsrdsrnsknkrstklfhknvdldqydnsrskep<br>krlnkkr |
| Contig40_gene_578 | 406 | mieeilktynttiegltnheakerlekygpnkiqeqesdgllklflsqfadaliflliiaaiisylignhldavvivivviinsiigfiqeyr<br>aenamqelkslvskeahvrregktkiipaekltigdivlieegnkvpadlllvesydltideslltgeseevrknadysnmgnleekirniss<br>hyqeeelrekivsmnsnvlsgrgtgviavgmdttigkiatmiqeedeetplakkvdklgkrigalsiavcigvffidffqdyniiegfmtav<br>slavaaipeglpavltltlalgmqkmaksnaivkklssvetlgsctfictdktgtltenrmtvredflldnksvlisglcnnakyetvdege<br>yeslekdnnrarnsseedskktenskeesqlignptdiaaynfakghgfdkldpehsytrldeipfdsnrkrmsviykketqneteyyiftkg<br>apelilnlsdriekdgnikeidsetiskinrkidemtnktlrviglsykqideedynkiknshndnkihdiqeelernliftgllgimdppra<br>eaidavascqkagievvmitgdhkdtataiareigilskedceslskhvltgeeldrlnddeyrniveeikvyarvypeqkrriiidlqskdh<br>ivsmtgdgvndapalkkaaigvamgsgtevtkesadmiiqddnfativssikegrtiydnlkrflkfqlstnigailtitigsllpiptpftp<br>iqllwiniimdgppaqslgleasednimerppergelldkktlikitisgivmtigtlslfiyelglnspygktkaitmaftvfvlyqlfnal<br>nyrsksnvknkmlifsligtfilqvliyvpylqiiifktcpiepfdwilviilsailiilvtdkianrlin |
| Contig40_gene_579 | 407 | mnliadiasglfwnslvmiggfivvialmtlligkgssadf |
| Contig40_gene_602 | 408 | mrtevrriagfgggvimagiiigkaaslydninavqtqsygpearggasrteivvsdeeidypkvtspdilvamshealikymgdlkdegvli<br>idpdmiveeeivdfvkehkiklyrapatktatedvglrivanivmigaivkvtnvvsvdaakkaildsvpkgtedkniqafeagyali |

FIG. 9C-271

| | | |
|---|---|---|
| Contig40_gene_608 | 409 | mdlknikiatititiafiiiglyaltevnyfsyknvvehddinasvviipsigvfekinnvsisggvyidqmsnlptkgdvvlfghrtlqgsp<br>flrldslkkgdivtlewpeigeinytvksskivpasyglylneshmeqdihnqeiylitchplgssaerlivvgelnstslinetaleenpha<br>swawyitlgffalglivsflspeeerkiilavviitiilvyfclfpissqiwadqlgwlnsmmgvn |
| Contig40_gene_609 | 410 | msnrfnsfkkgiskvknispkikgnsnrkknnsknkrskstieyivpensplrknstdlsdsdgffnsdylddlpegvsytrpvgdlsegvty<br>thpaddsydldgvdkryakyifgddlsdrnfkdprdssymedldndglnnefgrnrnfhksrnyadkrfnndldnngenykndsyldesysd<br>fsfkkdldngylngdaylsnsdfsdfdkdylddsnfksshskkaslksngikslknfkdglnkddnskrfgkivfililfvlassmfyff<br>vyqpfqdeinleknaklnelntlykgpleahenayilknqiesendinelkkididlmyatkdwrtyhkskivsskdnfgrvmlaygdenknli<br>msvkdanefvgdndgrvlsniqfekvdtiivpvsisrlqasagliisvgsivdiyslkdnysyggdedsnfesssalnesseglvenqsedned<br>lgggediskmpvdsnrpeedsgfsqngepdvsgatvlailrskdsgvidssisksntlvegnltdpyentssytndveellkasvfnsyddnka<br>leyylnsygiklsnyermsnladidseylvllevprsdvsfvinnmdnliltiptefapnwigelnetyydniynydlnsssfi |
| Contig40_gene_610 | 411 | mrlksvgmgyflavsdaisilniafgflailmvidnnliyasicillavvfdsvdgwvsrklnrvdplgfgmnidsladivsfgaapmailys<br>igssisswagyliaivcmitlvcglirltrynviadkinyrgfvglpipatailvtyylsglfniavaavlmllasflmistirypkvdnyy<br>liglgalmilllilpiqvfigpinlpalvlfvlavymfmtflefiddddmtfdrdkasdkvsnvreiteskvsssvtnvkdvfknmkdting<br>isnedldvglkedaeeekekeekevkeaeiveeve |
| Contig40_gene_616 | 412 | maidikrhkeklrqdepeikivpfidilftllflvvtstfgaatvddngsgsgkpnmtdttgdaeyylipvaglqkvtvdgvdmsseikgna<br>igvharvldqgdvqiktsehaiiikappgmspqeavhtpe |
| Contig40_gene_617 | 413 | miiemltdgfnmimemlqsggvityiillgiygllisirkifylrkiskidateimgtitssmeqgaiealknishyknpvsrimseaiki<br>gynkteveesmeqifivelskmtngisalktlielapflgligtvlgiwmtfknlgvnpdaaamaegiyialittiagltvailImplytyi<br>kglliddemdkielatkmtnwsyavikirvyeklpcvvealqeadgivsvkeitdpysniqistfkpsmleksisniilekcdvkseiteskIrq |
| Contig40_gene_635 | 414 | masfiptlnglgfayigakefknnwiliegviyeipwfllifvnnedigvffatiglIgmavsfvrslyvyykhkdilidddaesristeksi<br>tsfwvifsvviiflnglgliyvgfkrnvrqwilegaffeflwllffitpsnkalnsfiislgfigmilsvirtfmvyfeeermdggfysptavk<br>keppaqnpientinsysennlsdddivpefkgyktqvedlkdafktkednvnnlskrftkeelsygrfksvvnefhktfysqadstltminl<br>apeyservdetiknkiglmdsllgemnlleelilndglpeksdeeitelfenmhnlinsvddynke |
| Contig40_gene_638 | 415 | mgikefflnkekrkivaiekdlnnnlsilggysmgikeyfiekididlifilisliaialdllgvdiygisliwiaiifcgipifkeaaiglyte<br>fdikadvlvtialissiligelfaagviavimaiggyleeytvsktragiekIvdltprkgrlienynkseseresisadlievgdilkvvpg<br>etvpdvgkiisgetsidqsvltgesipvdklegdevfsgtinlygsfvmkaikkgedsslqrliklvefsrnpndaeivktadkwatlivviaf<br>icavlalvftgeiiravtvlvvfcpcalvlatptaimasignlskrgilvkegitieklakvdrvvfdktgtltygkptltdvivydeeteek<br>elihllaslenlsephplakaivkyymdnyddtllklsdfemiiakgvkanlngsnicagnleffkslgidipeefieeivspslekgataiyi<br>akdsrflgcallsdvlrkdasdlvvqlrrlkvvstlltgdnkqaaeyiakeadivdyqynclpedkistikkfqslklnvamigdgindapsl<br>rqanvgismggvgsnisieasdvclvsddikyvphllalsrktirtinrgiafalilnilatvlamygmigpiegafvhnigsvivilyssll<br>lryeyan |
| Contig40_gene_657 | 416 | mwaqvnttialvpnianlglpytmvrflsaekdkekirdsfypmisltfistviiclIflifghpiadalfngsmqvlyittaisffacmnlm<br>lityfrtfqemkryslflvlqsyigvfvsiyltyagynietvvlgIltgyaavfimmaflivrhlgsfgkwsnlkeqlafalptipsnvssw<br>vvdssdkyvigillgsvavgcyspgyalgsillmflspfavllptilpehyekgdmaevdkylsysmkyylllltvpaavgmsvlskpllyiit<br>tpeialggymvtpfvclgaifmgmygitnnliileknmtilgklwiivaisnivInlilvpyinliigaaiatllcymlafgvtaiasrktmrl |

FIG. 9C-272

| | | |
|---|---|---|
| | | pfnrkelvkiliasaimgavvymmnpsgivnvlvailvgvvvyfaiifvlkavtrkeigifkdlvk |
| Contig40_gene_659 | 417 | mkvvvcencgakyqlndddinafecsncsgslkelesfsdeeipkqsdessgsdsvlvycincglkfqiekdnindfecascggpldylsn<br>kseesqesqisgdsqgsdsyyetvsvyqsddiipihadpnysdsddiipihaesdsqtpyyeeliesdeiyanqyedddqyvseyekvlqsd<br>adsyyedeyddqyyqtdlqeegsgqisldelyytseypaydgtdeliipihaekrymedsqdsgfaygpngkyaedyleeyieeyvdsveee<br>spyvevidipedelpetpvvltrqvlseedqrlfdrvqnqmvfdspeeyeafkaarykyvvglldilkeeyllsmenefksgrsvknlikkgg<br>etvkqsnlyaddsdslvspetvelmksnrkyepkksnadviiiagffivivslayyffvsqimyvliafalglvilaygaykkyvfneyiarg<br>riirerllalpndfyvfyavqppqskdiinhvvvgptgiftilsgryds kdyknklksdtetgdmlsesasiqdyrqkkntlelqtdyddngs<br>rfqfgneeihftqnsqikrkalelnedlaifldkgfngiyiepligfvnddlailnviltnedlfidelfnkvirgrkrldeltvakiarll<br>syysancdvy |
| Contig40_gene_661 | 418 | mmfsniskdlnierkdylclfillvysaiitvllinfnesigiycsdvyiylynslvfarmgynntylyispldfglvelhflfrlgfvnevs<br>iyavtgvfsifgslgiyvllkryfnsllslaggvlftsfslnllwwangtldlpavglsvwailfililavdespkyyilsfvlvlsiftryt<br>clflipllllyylskhdlfgfldslisdrkeafssirsflkteefrylmialvlalivavlfisvilyygaelsfleqgstfasgskgalddy<br>ahttdtlfyfhdflnflfsqkvifqenfiptltgasylaylilfilliigisigiyrffnknksedkkgfdnvnssisnlkefsfktshfktll<br>yigllslaialigfkinsiitiaflligliviifsllkskgldrkdysvpifmigwflvlyfifftflnikvnryiitvfpafiyfvilalnei<br>iglldgkslkigdnlsniipivlivlcmfsafststfednldfndykivadylidydgdyaskdiavfkqrtfnwwlkdstiavttdqldf<br>lessnityyicdedlklenytkiynykdiflyervnn |
| Contig40_gene_662 | 419 | mnpyleilrpgnavmaaisvvlmmivghyydlpiilcaviyvfctgagntindvfdykideinkpnrpipsgrislknarnysyllfaigiil<br>sfvidyminsiwpsvivvpavvimylyarnlkamplignitvatltgfcfviagtviacatsslrilfisiylglfalfmtlareivkdmedi<br>egdklegartfpilygkkipsivsililivvttlmcpvlyifgifnvfymivmivpicmflycayslknppeevcakvsknlkiamlisfvaf<br>vlgsfdwfsifaal |
| Contig40_gene_666 | 420 | mrkmdkrinfvsisrftllvaifllllinkiqfhakildymalalaifaiiciiifilqfkkqlvefpikvvvetnvdkaladgaiteegaeni<br>pkrvvlnandiflnlvfnlaianhfdllpvdvlreyipdippanlmrlyeksreisddlndyfrsqkflnkadvitrsdeiktylretypwmd<br>dvtldntfdyffigigng |
| Contig40_gene_668 | 421 | mskknkanknkkkesdqtiheleigklikknedvlyinnpdyfltfsdleisdgidiienimilskdyvsfnrqyedekisdvelmeiteeyk<br>enniegyisqsfdnsqfflinsyndititivisndlevqkftdnlkvvnswkgfhnakinfgqillidhalspkllilqlyktatkqkakffe<br>slhmplhinnilnnedflviasnlpeetlnqdyimeigldtnmeyeddkldleefgeriedgvtiscedairkinlnigildyfvsegilig<br>dlvelgmellenteptdelkeklkkqllksvsdrninalimaairleddfrkqrvreidlneklvhfypdeliqvaianqisgtkgvlnyrry<br>srhkpgilyglgpilsntfaglvagcmtkilee |
| Contig40_gene_677 | 422 | mecynhpdreavttcsvcgkavcpdcameiagnvyckdcvneivtqsimekastqapkeaaepiteevqeaaveeaieepveiitpvqeev<br>eeiipetpkkapenfepeveyeteyvetydedqvedsyyenpelipepeykererivkeeakakeeeilepvhktedipkeayndmead<br>fyeeqpskapskdleakyekyledlyydedeieeeiyeapktqkrrskprrpqredsyydedhkrsprnysngeyyinpreeefeeeefitp<br>shsrkrarseetesyeelkrriernyakegeakenrfrrskkskkqkrpdyeydeleniqemhsfpeyekedkigildilalilivlilil |

FIG. 9C-273

| | | |
|---|---|---|
| | | ilyviylfrlngeyfsfidslglvrdpsgyisyvln |
| Contig40_gene_693 | 423 | mseeesvpqiivstddmaainkldeaeekvefavgeyfqrlgqqngrdigilygiilglvililvsiefglvsamstmltslv |
| Contig40_gene_694 | 424 | mvrfsnkpntrgirnasnnveyraklIgregrlfagvistrfsqmaigiglalalavvipylaklcgl |
| Contig40_gene_695 | 425 | madkkpaadnwpvvsgdyivgdpespvavttlashnedipaaagaaiagpcktenlgiekvvaniisnpnirfllilcgaevqghitgqsiqal hengcdpekkitgatgaipfvenipmegverfqqqvelvdlidnedggaitakvkeciekdpgafeedamvievkegdddedegeeirpisa etallearirnidtqvklvgavqrnmagnysgkvqgimigliftlvigflllmapllga |
| Contig40_gene_696 | 426 | mviplqifipelnlnldpetgllgagggdliilsmdeingeiakveaaadelmnsldpnsaplgsfpgregnfviagtltnmvygfiigmfli maampiltamgvl |
| Contig40_gene_697 | 427 | mdqviaclgavcailwgvlairsvasyglgtgvpsigymslgigvigalagvgiiaafklkglemlgpilalvfamliglIvaivakkivgmk ipvmerctaeiagaaalavlgfssaiaggysidllltavvapgfialfyilvtmaiqhpfnaclgpnedqvrtlkcgastafltmiitgilai saggyawfailvvgligwyvsfkmfvnasyeaaasvkwsglwpkvee |
| Contig40_gene_698 | 428 | mdllifiicvviagiimggvhfipvggapaamatatgvgtgtamlaagagltglitaasmtgqpvwliviagavgsmlmngitmlignfiyi fgvgvvpasgkaavdpitgwnqekyktpgteghgiptvcyisgiigglIggagglvywainefatanltgfdatviaglaailsvgmffins vtasyniggtiegfvdpkfkrlptgilacavvslvaaifmvlmiggi |
| Contig40_gene_699 | 429 | mdpitlgvvalmgaaatiagaaedlesdigsqsnpnsqvqlapqmghlhrminkaasgepvaygcwcgisgaialamgmglipivaiamgst vaalvhaiytvtshmgrivgqsqfeqplfmdvltqslgpiaahgfiasfgivgiaylmtlpldglghpfplpllavlwgitigaigsstgdvh ygaeseyqkfdygggtpvaiggdivtkaplgaknsidvgnfcakyggpltgfcfglivfvsfwitvvfgalggqivgiviviliaanyllek strakfgpyee |
| Contig40_gene_713 | 430 | mtiiskkvelielfydlifvyaisrltsiisepvngiapfslfayiitsfvilqawlyftnyvnrygqwkwyeyviaiinmiaviymantis stwnnyfvfnvsmlimlftvvflysvhaikekslkgaagnsitillvvcsiyiistlsilfghmdvwiwlnvlailtgaflpfflkgkfdksi infphlierfellltiitfgeavvgihtffnvnndfvpilvflivigmfgsyvlqihylvddhhreerslrimfshyfivisinlvtvafelih sgeinywipslmviislivfylsimankeyyydglelrkkdialmvlisligsiaillsvgsiygfligaliitlanfgvllnkyqkfndn |
| Contig40_gene_722 | 431 | mfiifplfsanlisiligisvllifgiglayssfitheisgalssvmgifgivmiifglcfifainaisflvglqfyivafmlimiavvgflsd snvartgallylvlgiviliilliamfaaenplilitilgviliiaggimgliygnel |
| Contig40_gene_727 | 432 | mrreclkligtahvsqnsveevkeailedkpevvaieldrgryirlmnerngivedqdihitkiikenkvgvflvttilsymqnkigdldidik pgsemigaidaaeetgsrialidrdinitlgrvlnhmstweklkfiygiiggllssddeeldvealkeqsaideamgyfkeispgayealvne rdaylansilhipedhviavvgaghkeginryldnpetipphselidmdkkggipwlkiilalipisfvviflawmngihiegdivgfivis mimgflgsilsgsklasaligglvapltiihpllaagwfsglaeakfrkvrkqdinnigkiesfrdlwnnnifrillvvvgtnlgvslativi lpsgvfiplfmkifgg |
| Contig40_ | 433 | memdsiiiiseiliiiilivInglfslaeiavvsarrirmqkncr |

FIG. 9C-274

| | | |
|---|---|---|
| gene_729 | | |
| Contig40_gene_731 | 434 | mllikgadvfvdgasnvaynlkiptiivgltivafgtsapeaavsitsafagtnaislgnvvgsnifnilavvgvsallgtltvdkvllkrdf<br>pflvvsiglliatifgeisrlcgiiifliiiiayvvlvqeargdkeamseeievklsipkaaiyivigiagiiigsdlvvdssyiasvfg<br>lsdvligltivaigtslpelvtsitalkkgdngivignvlgssifnilfilgisgaimplpiapemvwdillmtvitiigaafaytknevdkk<br>egavlvalfilymafvilrn |
| Contig40_gene_740 | 435 | mdsdddwknsliaylwivmiwigkivndyriikihkn |
| Contig40_gene_747 | 436 | mplilvafasfiialdatfmnvsisplvidlntdvgtiqtliisfytllitasimlisskmqdvfgkkkifltgalvygigafiasisqnaimlf<br>igwsllegiggalmtpatisiisgtydgqmrttalaissaivgiaaaiglfggvvttflswrygfvfelllillifrkripnfastaskk<br>dlditgsllsaigliillvlgvlmisgktiglsigiliiasiivligfglfekrrkangkmplfdvsllkdrnlsrgtlirllitaiamggslfsi<br>siylqtvlklsafntgivliplftfgmlifsimapkfairlshkyamiigfsiaivgcllisyqftlttrfidllpgmfiygaglgfpmalsvd<br>talintppesqssasgfvstgqslgmsmgtaiigliilivgavggmhdaintyapdkvtngefhdnvggyfeklgnvnttelkhenslkekivs<br>kvvqdamrlvmyvtalllaiggaltftlkkqkikg |
| Contig40_gene_748 | 437 | mgnkeekkaargrfdeiigvakrhhlaklltnneddedfevsdlryameelgpafiklglllatrpdmvgndiaddlkllrdntpatpfeemr<br>kviegelgkpleevysefneeplgsasigqvyratlkesgmevavkvqkpgiydvivpdvkilnnlagtvdkhvsgsrtynlpamakefersi<br>fkeldymeevrninkitnnfkdveyikipevypeycssklinmelidgyevtdlfdneieginnteiaqygtqsylkqvlidgffhadphpgn<br>lfvtkdaklcyidfgmmgvvndtfrsnfaqlilllidgnshhlinqllymniispeqntdefredvddlinsyigvdldqmdgifdnlmnvmi<br>nhniilprefimigrilliedagnrldphfnltaeleefakkmirtkfepgnlvggfnyiveiehllkdlpdrlnstldkvekgelelnmn<br>htglddlknqlsialivsallvgssiailadkgpkvwdisaigffgflfsailgaylvikyirk |
| Contig40_gene_764 | 438 | mvllgamiaygltpiankiqtkikypsisiflalilvviplillifayvfyeitvfadvffnssdlagmdinnalnafvgnlpvelqgfikpym<br>gslstglesalsyvlaytvklvkgfsnvliqlfvllcsiyyftrdgdliwenifvfipnehkaffdrtfyeianvlksifyghfltaviigvm<br>ggvgyyllgykfalflgliitgifqlipifgpwivywalaiyaifvagdivqavltvlwgfvlslsdmyirpvlasnyadmpslillvgfmagp<br>yvfgivgfiilgplilgvcyaviksikeelekdnwnsgdeegsddgdsedvkeisdnldevsddkksnedskdldigieeki |
| Contig40_gene_770 | 439 | mkkiigiifiiivliviggslvyknykdsqntvdksqesieisknqitmlipgdwveaksesnttaiaaadpaskdsagfssvniniekktsyn<br>slsyefnnnykalgrdssydilyegnvsiagtegmeagytssktgflkqhkaiwfkqgddlyvilctapqskfaeeestfdfiinnlkfnnst<br>n |
| Contig40_gene_771 | 440 | mklmqilknlerdyndgliseekyiylsnqyrhkidtidtsnrirtmggkkkvsprpyskyedanyqksrdederlvekyihnpesyninsrg<br>kktksggtspwyialavifllafgagisfgifsentnsdvgdiitasatindtafpevkqtkynrtsnytkyssnsysdyssgsynsyn<br>syggsgyssggsgyssggsgyssggsgyssgggsgyssggsgyssgggsgsvsid |
| Contig40_gene_780 | 441 | msyeislisilevvltliiialfigvlipgierkyvqariqqrigppvtspglwasikflykeniqpnsmapglykampvlcfivvlaifvlm<br>pynyqfmafssliaivgflkveevayvlmgslsesvmsanlrfpdhikgaarpdslvssiedisskrslrmivfgsfplylalfvpaalsksi<br>yladivayqqangpflftlagiigavvffvgymiilneypfsyikaksdviegpymelaskyrsfvyvtrgfliftlglvfsvlfgippvlf<br>swkfiaavivslilpvimasisafspiftnkglyptillvsamgvlaivialf |
| Contig40_gene_785 | 442 | mfvlanlligpliiisvifgfvlgsrihideknsfkftasgilialiigalivsygigqfpyyndlpiattflgalfglligsallggrakgdh |

FIG. 9C-275

| | | |
|---|---|---|
| Contig40_gene_786 | 443 | maedkdlkttkkspnwnkdesspilkimvlpisfiiaslgimvilgghitpggfqggamiagaiilsvvvytvngsplklshrfislllesvg alayvllglaglaltgsflynvggnlyglvpqaiaaifkypdltnagmvpylniavglkvlvglsaiviafsqfkklaeee |
| Contig40_gene_788 | 444 | mnnvsgamaaeflilvglilaalffrhiniaacivvvilaailfftnmplaskikseqdslekmlfyvlivlgilisviywglkyv |
| Contig40_gene_789 | 445 | mvvipilaalivnilggkdktvkafssilvglaipiiailaaigvqvyfgghdpgllanslpsnlvgtlvasyntgivyifdnierififlmgiv aflsiftyftekkevsgpylylifmglasviallsndifnmyvffeitaltqvglivasstednyeialkylilgsiggpmllgvgfvlgt igsvnitdiiyaisnnfvdpyspglvigfalilfgwlysagipphtiksavyskarpngsailqgfsvlcmlafgiamykifayipgfntai ivfailamvlsiamsamevdfrrmiaflavgelgfialgfgigtqmsiaaalfqaaneivitamlfigfgsiyyltntsdtrklgglligvdsl mgvmillggcalagvppfngfvsklmlvqaaleagytelailavivsvviffftvkafhsvflepkpkdlkfvnekiprvtvfsvavllicl alglfpnivtdvfipfaggli |
| Contig40_gene_790 | 446 | mimdiqlaslfasgalililgliiaaifidniikkiilgiafieeqvnlflicglgykaggvvpiflpgmtadwfaqnsayplpqalvltsivigas tlavmlalamvlyrkhgtlsakeilgdek |
| Contig40_gene_791 | 447 | mieyiliivavisaiiallqedliksailvgisgffiavlfhllapdvaltqaivegaivpvfialavyktkgga |
| Contig40_gene_792 | 448 | malglegmnlitligsillilisaliliiiaaigilrmdkdmpnvvyarihilgmidvagiiafiglgqplfaliyiflapllahalanayfhae ddlnpvlnpnllneesdeseleesvdvaeqdgeepeesvdvaeqdgedsdseetsenveedsdseeeasnedvdnktteedvenlnnsegdd nd |
| Contig40_gene_793 | 449 | mimelllisecfliialvvflfasmriitykvsmgligtssltiaitlililcvgmmwgieffkdialvlliligivgtiayatfirra |
| Contig40_gene_794 | 450 | mflsriyyaiaylvvileiikatidmagrifkgdqydpivididtelkrpisqtilansitltpgtlsvdldsesqvikvaviaprdvkdii pfepyikgmle |
| Contig40_gene_795 | 451 | mssykghtifafilsllmfydpfaialaviganipdfdhefkrnhvliiisigmiisiflyllnipiylgliialiglifllsshrgfthsil gavvisiaifllvyfgmdlssyfnlntitniplnyvilvgililflavlflnkqlasifillmlffitlvyfgivpvfkinvyslifsvflglf shmildsfspagikpfspfsdrkcykklglllfaliialylilfpnkldfyinliphfy |
| Contig40_gene_800 | 452 | mknrnvwrilmseikkymedlkknktglkgilvililfaygilgsyyimnlninnsiyytiitiatvygdiipvtplekffstslaltgigl iayiftlilitsfeenlhdirsgrhmekrlakmedhyilcgfgrvgtavyeelmkrngkvilleknedkledieetenvvpfnanatedktlkk lnidkslgvivttgsdvdnlfivltremnkdawiisraskkenikrlkhagankvispevsggtdiyfaavqpnlvhitqkhgidylerefe ilkkhnchlenieyhfpgiktpvtrtigvldeeekdhfidmvknnpevhesmdvmyetvngvhshwisgpdkshvdmvieelkkegnllgvnl dfkeineftkqfke |
| Contig40_gene_803 | 453 | mknklliiflfglaimaamlyfigidqvvdalkysnlwfvllavliqiftyflytwrwqiinksagmtlgiwkllpmvlvslavnnitpsgr gggepvrayllakeghykfedtfatviadraldtfpfvilaliltiiaiifsvslpvywivilvcvvgitaivilillyvcineafgvrltewi lkitkrfyknyndalekriveavasfqstmnalirdkniiyyalplsfiiwvfeilrvyvvflafgakvspiiigevfiilaslvgmvpllpgg lgaidgvmilfysrsgitaslsaaatvversisfgmttilglilfmkygtsildasfklaesekaenleeitedeqkildqisedgdksedsd enreeavlevldgepsievvdeeptievidddeptidvldekeeaidekvkn |

FIG. 9C-276

| | | |
|---|---|---|
| Contig40_gene_804 | 454 | mqglgvvlivptlvaliygeydpiapfmipcfvsfvlgtafskkfkdytklrlkhgmlissfawlwasligasimvlslgipfvdaifenmsa wtgsgmtffvnvevlpksilflrsleqwlgglgiviifigiliragtaasrlykseareekikpnitntlrkaleiyliytavgiflfilagl pifdainitftsistggmsiknanvfyqdsivylismflmilgatsftihykivktkgkalfkdvqfqlliitliivagaffiatnkmvpiee lftivsavtttganvvdphvlatwngstliivlmvlmliggssgstgglkliriitvlkgmnltvtnlvspegrvvntriggkkinereikea sayivtflmflvfgwiimtmyggydpftalfdvisiqsnnglstgivygglplplkitliflmwigrleliplvlfrtfygvnpkrrikqmk ktngndkktn |
| Contig40_gene_816 | 455 | mkkssiiiffavfeiiailiflfitindifylfnftyigaclsiglylynvdskyskyarnfiqlaiglymlvylgiisrenmmiegfwyylfg vfeeavihylvakilgpflfgrgwcgyacwtamildllpyktpnknldherknfgfiryilfiasligvglifmmvpnlstvmfyliagni vyytvgiilayalkdnrafckylcpttvflkigaryslikvkykrenciscnkcyrvcpmdvdicnndknkngtecilclscakecgndalf l |
| Contig40_gene_825 | 456 | marhksnkrlnkgeeedpmsgaanlvdamlviavgllvflviswnnqgivfnednmtpeekqevmqqmqqvteleeqqelndtpdvsnssgkgy tengkvykdsstgklimveg |
| Contig40_gene_826 | 457 | mvtvipgsdlltsalnvvsqslqipvivflliifavyavitvggliseyssrrkkvpvkvikdliyaisrsedvtelenilknaripknqkrvli niarsgelkkdsrealaeklieneediiekklqktdivtkigptlglmgtlipmgpglaalgsgdvttlsnaiivafdttvvgigsgavayvv skvrrrwyeqylsnldalskavldrlne |
| Contig40_gene_827 | 458 | mlwqfgilaavlfgiklglavglanlskkylatvcigyqaqvlilaqissyfateiteliytynslffiimavimilagiftirewkvfekn ttaatcaaviapcpccfgsiivsillvaptvglgavdlsvyvaaalvltiivtfassifvryvdkpypivlgnfmfflgiyfllsalvipni aaimnksmgsisivsmeslagsivalvllvivigivfsrknnils |
| Contig40_gene_832 | 459 | marrcnrrfeseeedpmagtanlvdamlviavgllvflvlawnnqsvlfneglitgeekqqvmdamnqemtevqeqqilnetpdtsnatggqy tengkvykdpstgklimvqnnsa |
| Contig40_gene_833 | 460 | mtlaigntllfadealyqganglfaifsntngtgfpfldssltaitqalqipviililiifavvtlgkllseylsrkkvpiklikemiys iydaqsaeeiknivnssdiqssqktilceladsehlgkksretlarrlidneedkitqnlqktdivtrigptlgmgtlipmgpglaalgtgd vttlasaitiafnttvigigagaaayfaskirrrwfgeylanldalmdaildninkrddrle |
| Contig40_gene_838 | 461 | meielaiililvaaivfliyyyfqtvnggsfdiddikdhltiskreaatatvnlddeaeekvsvgkkikytfkdidksysnttafskrld aflderseelienwslvttddleslekrcvtacdsiddlekrfseysnvtnekledldkrikaleedselleedaetiekeade |
| Contig40_gene_839 | 462 | maneiipseifililvvilafvviiialqwkkvrqsdntlklmekeielkkiamvekdlenkrlmenpislpseqqeqltqirdstakvmsdv gylhseinerlarleaqtelklklekmlaeiedekeklnkgk |
| Contig40_gene_888 | 463 | mekpqlvnfiakvledsgfkvyknfktsqqtvdiyavlptsmgdfgmvvacknydkewevgidvlkemevigkklkaskvsvvtssgfssqak ryaeerkiklvdrndlvalakkynnkkqenepvrlrkespanidrdsfynrdvsrdyidnvngtqydaglnrvpnpydsyeeyesdidyen qvggidlsgysaydddlyraeflnrhpsnesnyngllianrdpyvnskpssnsrslfsrnkateklsslnsrgytkntnnnnrqrnsrttt vsrnkspsrnfissrdnalskfsrnesrssgglkemikpilgntivsliivvvayliafilgsivkvptgylgltelavalvlsyglvfytd rgsdvlvkgtiliffislvvlmiliaf |
| Contig40_gene_890 | 464 | mdilqailiglvqgiteflpvsssahllifiqqalglsnvplafadvllhvgtlvavfvyffsdiiqmiqgffyslldirdgnfipeirrdpykk lawltiiatipvgvvgilfndiieemftgltipafllitgcllyvsqrmnsgkidvqnitikealmgcgqaiavlpglsrsgttiaaglfa gldkefaakfsfilsipailgaavvqlkdlsggnieigaclvgfivavisgyfivafislflkivreksldifayycwlvgvlvgsill |

FIG. 9C-277

| | | |
|---|---|---|
| Contig40_gene_905 | 465 | mmlnylfnilntntfllnpkerviggillfilmsvfslfisfitlaspnlffpllisfellmlflglinislhsiytnyfnmlvsenpvllsy egivnllclslgafsfwlsiaifigpfwaffsfalawllplwimffrrdifnekskvisknsdkligyspiwfylfgcvslfipflvmfkiv ffskfnflaiglliitlietlilifcpdywdkilpfdirtkkgtflyflslililscislilykiv |
| Contig40_gene_912 | 466 | mlnlnkktiigvilcfilaipsfllgnlfpiiggpliailgmiiasfwkdkgsaeeginftskyilqlavvflgfglnlgvivatgigslpi iigtisialivayimmkvlkmernsailigvgssicggsaiaatapvigandeevagsisifffnviaaiifpmlgrmlgfstvngdafgif agtaindtssvtaaaatwdnmwglgsatldkaatvkltrtlaiipitlalsyiigkdngeksneegfslkraptfiaffilasiittvavf lgvdaslfipmkeiskflivmamlaiglnsdivklvrtggkplllgascwiaitivslilqhllgiw |
| Contig40_gene_920 | 467 | mseesssskvakgsaliligvnvifrvggyiyrflmasllgpaaygilgltt pfqqifqvlsaaglppaiakyseynaldekdlarqtiftsl kimvflglffgfimvfvaapiitnnyyhkpealplqavglitpfsvivggfrgafggvykmeyilytraieqifmilmatalvllglstlgav lgsvlgfvasaisavyifkrymgkyippanpdfkfplkdelklaktliffsipvtvaalaemgiysictllmgaflpaaaigyftaadpiarl plvvsnslattilpatseayalkdqvllekyvtapykygmffvipmcvgiaifargimglvyftnaaymngavslailvvgmtfysvytisgs ivqgignpripmyiligcvitlglgwyliplfgieggalattissfimmvpmfliqfrmtkthapysflikvtvaslimaivsiivpnnvyg litgivvcpivyvimvilliktlshedvaefrkyanklgpirkyanklldfidkhssd |
| Contig40_gene_926 | 468 | mlkilaadkmdkklivryimlivgviimsmgialsikatlgtspissvpavlsiafpwtvgeftivfnallvifqmvllrkitisqiaqmlvc vlfgymidfsllllnfpnptdyisqwilcliscfvlafglllievksditmlpgdgsvvaiaevtnrdfgqikpffdltivsiaailalvflgh legvregtifaailvvgliiigfvidrifgfgynidaylad |
| Contig40_gene_929 | 469 | mnlenksidllnpfiiiamvivfiiialpmwyayqklpspsmdlflyiglgliffifgilisnllnrflkkdlsldslkdtikisisknpkk lsifesysrkemilvimvligiilqiiinivrlggiplfsatlkaeeagkiwlasyiilfpfinillaefnrdshyllvflglllftlgyrtt piaivlsilitlyytrnikfkyqvlfiglflviavallaigfiavqaiswqhwslnpielvsyraaftlnvlghaisnqfatagklfystlt gffthtdprvlvggatlgrnhsitstifgpalldfgligmciqmlligfilktllhsiqkhkkevysafygillaqtiiwietgptdvvwify liaivlmalfflkgssrdlea |
| Contig40_gene_941 | 470 | matvdsflpdfiqttffsgytifntvlyltlllifiiaiikmfkkikidpisilypiipyiflgsliralvdngvypktvflitpglyilvgl itiasllfslflynrknidyrytlsiigvillipnnimiprlniipvlyvlitwilassifvlisyiipffkdrinlsisahmfdasttfva veffnyseqhvlantlyqlfdtsitmfpmkiiviviaavlyiidqyfddetikslllkltvflvlglapglrnfltmaigv |
| Contig40_gene_953 | 471 | msnnqisgcsyalyldgsdngsfignkifnndygilakysninlfknnsvfnnwiaiedsskynqflsninhdnyqgirliasnsalientnv ynnylgilkyssfinksasvynntllnvqslndgeivlgdnmwycgpaalsiifeslglslsqediakiagtntngtslyglyqacikkgfn psvlkinssdlmtndlavllinedyhfsvlysindtdivlndpsiglfvlsretfdemfsgyvldvepikdrvsnvsiakmktivgtvfpala yggylalagvtviagslaivwnsnshynsksiqkphytwkpnnkihfprnvkyptstgnngnrpkvsynpvtssisgnkyytnnkvytynyks snrkvsssnaaliayqeaynylstknnerakvekptnitsynyflkdvkafekgsykfslgpkgpdddlydsakivkalyrdatrnynygkf lintgnksrgicyiflatfeisfipaiiynqlsnp |
| Contig40_gene_957 | 472 | mvkcskcgsenkseakfchscgakldikdpynldgksreygsttgksagsasayydhsansggsssdstggidnfrnmsnfkkiifaccavfi vlfilslaaqalgfdmepysenktayhnysldlddddgalcleeleieysnissskmsdifkksdknrnhlirgaeydmlnyvnehfkdlek kknektssssssssssssssyksp fttsgssddgaetcpfcgseavyesgnsykcaecgrtisnpddldlnydegyy |

FIG. 9C-278

| | | |
|---|---|---|
| Contig40_gene_958 | 473 | mkkcskcgsenpdnakfchncgskdfgtnenicpkcgesnvkeaktchkcgaslsnsssgsssynptgmngpfgagandkpgsvmngpfga gandkpgsvmngpfgagangvadsfafdpssndkssssnsnssnnsssnsssnsssnyssssnsnsssnsnssnsnssssnnsnsssnnqgstassang snstastknqsnstisstttantgnegpglkkicccyvpvillvlfifaillnafpenfsatyddefyqldidgdgrlsleasqlnpgmsds sissyfneadknnngylighefddfysdvkpyssssssssnshkyssssssqssnhkyssssssssssssdydsssdgyvltcpycgseaiyesgsyykc adcgsiihnpddlelnyqegymdllapivqinlggv |
| Contig40_gene_960 | 474 | mvipafneeatvaqvvtvarklsyiseviyddgstdktveeaeragatvishkgnqgkgvaiktgfknshgdivafidadvsnftptkidki ikpilegktdittktkfaresgrvteltakpllsfffpelnyeqplsgqfagkrsalnkikfekdygvdvgivldadvhgisilevdgdiqhd mssladlnkmanevvrtiidravdygrvtmmdtlgnyirmaingsliilglfmiffvpfiplvisvlvalvgialtiayliikivqrsipilr kgdtstalksfvkmhfpvivsgliliilmistflsaatfndgrisveltsrnfvyspsddyhqtisvrgpytidsaienetdmvrippdalstl emsandtmiidgeyysvntsregevdvfrlskavrhdldldlyprevipnsrlaevfngvivnhninfnnssevmegyvqfsispkatnatffnl tldnesllssvgnfkndsyytiaydddilcaftgddiikkgnvtfeyagkdgmivfedrnntsirnfidsdrdsfvklytl |
| Contig40_gene_962 | 475 | mialvlaptvlsltssvtaaalvivgilmivglkevdwdnmvvaasvfmtliinmlltysislgiawgfvtyavaaiatgkakefswimwlmv iifaayvffgl |
| Contig40_gene_963 | 476 | mlnkffkldenntdiktefllagltflamayilgvnptmlaeggmpatgvffatalasgvsciimglvskypvglapgmgmnalftytiilam gntwetalaavfvssiifilitisglreailnalpfdlklaigagigfflafiglkgagiivadpatlvgmgtilsapallavigililtlily ikkvpaavflglvitallgviftlfgfgagdplmpaiptefisfndtsvvgaflkgfsqliftnipnlimilfsllfvtffdttgtliplang cgfvdeegkadgidkaflgdaisgiigailgtstltayvesatvlvlveqv |
| Contig40_gene_966 | 477 | mervrlqyidllkffaifsiialhvflvwpkakvmgikvyslssivrfgvpvfimisgallnrdieigsflkkrinritypflffyiitfif ialtnhtheqgnifafrwyfwtilgvylsipiinkyiqhssikeleyfiyifasifyqftyffeikqyfyltlflsplgylvlgyylskkd fnlstskmivisiilfilststsikicgglgyipitenfvasqsvilsswldvsfigilqaasffilcksiyeaskgifspikkflesniiskfv lsvsrasygmylinliptvivyyiqpmnltgsqvflaiplisiiiiflvswiiivilckipykyvsgys |
| Contig40_gene_971 | 478 | milgtylimpifnrwikdcsireveyflaiwlitcifdntllligpfvtltyftgpigmvvlgyylrhtdrkifnslpyalaflligmivimlc syflsspegmyvfdrysillalevvgiftlykvidkkelkifhkengffrrasfsiakysygiylchefimnifiiiiflkhapfkvtlllvfv ctlgtswallallnrvpylnriigak |
| Contig40_gene_983 | 479 | mdnqnqwnsriaflsmigaavglgniwrysyvvysngggtffipylvailimgipflvleygigfrhkdsfsnilksinpkleyiswalvli iyfvliyylvivswdlvylgssinfswgadsalyfvqnvggsnlsnmasfiipttismlvwicvwyishkdlnegigkaskililpllfgim afiiivfaltlpgagigisallnpdwqmllnvniwlaafsqiifslsmgesisltyasylpegskltdnvlivvfancafevctafgifsilgy msytsgtpivelvsegtglvfvvfpmifnimgaighiiapllfiailfagitsavavfepminstvhklnwsrkkavtvwsivgcivsllftt gissylvgivdsfitefcilllliaiqsiiftwfydiegvipilnendrvkvgktwvflvkyilpillffmwasgvyhllnantfelivygli tvfiiiltyvftnipeks |
| Contig40_gene_988 | 480 | mtikkyfktrkgtkksvqerdydsdysnkglhkesriknllndnkgnysivisaillisflilsilvlntvleereehtdtiasnqyviied ykrnlpnierealeelslyvienkrpcfnsrddlkelidelklagknqeyyqrynieinssiigientsdpfsykfktyissvkgdfsyeeide syvncynlkdpvpvlfcgddssfriedysllgdsdfgthdsnfenddssnqkvfyghslakflrrhhvenysfyenasspfiikrcpydpyk hhgddngrimkncrdngyyhesadgacylcrlegksgcdhygfetfinpqktnetggvsacgsdhvifsddiypgveviynsenglneilyld phghkvkygmsey |

FIG. 9C-279

| | | |
|---|---|---|
| Contig40_gene_989 | 481 | miemiklvnelkidqkglmysselilsliliifiigimanitdsvnekvlsqeelssleaisiesvdyllnnpgspmnweedeglnngivsrr<br>iipglainkksvengffyeesssdeeipnsisyikllklqsnyddllnrnllfnstlkssitiyphsdidiiamgddlesssdvvainrtvrc<br>dylsnfviyrfndfelygenykktelcnhdsnvnlsnhsndrryfwlcknfriyrsslnnynnyylisdssirhansyyilesslnrtrddmerl<br>ndevielnpffaedmvnssneiysihfkvphddiddfktvmvaihknmtdeivsnnqlrydyfnsgevdfvlktayr |
| Contig40_gene_991 | 482 | mlvkkmlrdlsdhkiqfvsiflmaflgvfaftgingevvgitdvsthyyedtnladgwiygenfdkdtlkdiknmeevknahremvvdtvany<br>ssdpditlhilegkeiskfhlfkgkdfnpndkegiwidkrfadardldigdkislkfdgktvsktirgliiyspeyvyyiqegsmipdfsqvg<br>yafmpskgadfdieynritidgkkeldakefssevsellgqytyaqfvprednvgvstlqdeidqhnmfsgifpiifvmvalltltmsrvi<br>ssqrtqigtlkamgydnttiilhylsygfflsfagsllgliigpltlpylfypsmsamyslpywgpawnlsfflvaalmviisvltfisvkt<br>indenpadsikpkvpkavssgimertkiwkkmgfngrwnyrdakrnkvraimsifgvfacallimsafgmydsmndvgdwqynqiynynskly<br>ldenitdaqlstvvkdtngeenmeqaievkyrgnkhtasmtvyndselfrptdinrnyieidpdgvaisdrlaevlglkvgdkvrwhlvgnpk<br>widseitqtystpfgqgliimsektyekyggddynystrvvltedkdiknytgvtsvstredivkgwednteamnlnvyvliifavilavvvly<br>nlgllsfteiqreiatlkvlgfntkslrrllltqnlwfstigfilaipgayilmeanmgstgadyyfpiniyplnfiislimtfglsilvnll<br>fsrkikkvnmvesklksne |
| Contig40_gene_993 | 483 | mkmirqfgessialvvnlilflfngikyiftlpnriyvyiklfledtdavlkeslialsicavgdlcagiilgnmefflktypglmviipgai<br>gmrgnifgsfgsrlsthlhigtlspefkrseilsenitaslliltmvlsillaviakgvclafgfksisiydfvlisfiaglistiimlpitmf<br>islksfeqqwdpdnittpfiaavgdfftlpailsviivgfisliipivkmivfvavifvtiaaliagytaksdvrhivrqstpvlficsllgt<br>faggilndsllttllknqtliltlvplfsgesgglvsilgarlssglhsglidpvlrpkkhtvenfvailtsvvmpvvigflaesstiafgnig<br>vgilesmsisflagmililllmllvvfyistisyrrglqdpdniviplststlltdsistlliliivvslglllnyvf |
| Contig40_gene_1003 | 484 | mltillfslavdlllgefpmqihpvvwigkiisffknllikydnkiagliilsiavivssllivlipmaiaryllpyndmmiylfkliailll<br>tstfsvklllsardvekdlrmnlnkarqavsylvsrdtnelnkehvisaviettlsenipdsyvstvfyysivgiiaslcgigdfdvllav<br>laafihrvvdtmdsmvgyktkelynigfipahldalnyiparfsgalivvsamflrlnwknalfimrrdanncdspnsgytmatvagalniq<br>lekegvytlgdninpinvdciekavdlarltiflvtiffmfvfmdlillml |
| Contig40_gene_1007 | 485 | mlkrkmlrdiwnykvqfisifiiafigvfvfagltaeadgfeasidsfyqrsnladgwiysnylvddflkqvyllgattsmerqlvvdsqael<br>dgkpditlhfvenntiskyyplegnelnisdsegvwldktfadarnlkigdtiafesngikiekkirglgyspenvyslvptqtvpnytargf<br>aymsykafpsdnityvnlnvkfdgrpeifsellsyrldgvyelylpqsnqysnvavsdsiahqsslnavfpilftlismlmlsvtmkriisnq<br>rtqigvlkangfsnrsiahymsfgfllvtsgsilgailgpivfhfvvhesriyyfkfpvwayvglerfifviviislisliivsylsiksivn<br>eppsqiikpkppkmvssgfieklaiwkrlsfnirwnyrdikrnrfkslmtivgvmgctillisgfavyqemeiskdwyfndvnhfesklvidd<br>ntdlsqidsiahkvngdeimessieilkgcanfasllvlndtdlitmtndnrekidipknevsiskkmadildlkvgdtidchlldsnklvki<br>ridrihstpftqglvmsadkyeelgfnftptsiitsehvnksydgvkstiysedmvrgwdqmqktsmmiitsilflailvlavvilynmnllsf<br>iemendiatlkvlgfkskyltkllatqgfffiivgfilglpvayyiltllmpafgnkiylipnisvlnmafsfliivsfivmnlyfsrkirk<br>ldmvdalktfe |
| Contig40_gene_1012 | 486 | mnqnaqwnsliitfilamigltigigniwrfsyvlysnggsffipyfiainvmgipflileyglgfslkksfsklmhdirpefeviawmlvif<br>vfivviymvliigwdfvyflnsfsfgwgscpnsffmtyvggtreisqigrlllptlicttvlwliifwfvsnrdvdegigkistilmpllfiim<br>ififlysftlpgfdigiktllkpnwslldihiwlaafgqtiftlsiqgamvytyasylprnsklvdevllvvitntlyevfiaigvfsilgy<br>mslkssipiekliseqtglifvvfpkifsemgfvgqiigpllflsilfagftsalalfepflsslcdkfnlsrrkgvtilvivavicsipfst<br>gissylvgivdkfvndfgililligvqailifgwfygvekvmpvlnelstffkvgkswvftikyllpvliliiiwvngvvglfsntnsfelivdlii |

FIG. 9C-280

| | | |
|---|---|---|
| | | tfvvvgfsvlftklgvke |
| Contig40_gene_102_2 | 487 | mnkklieyliiatviililygcyslidyqsngyqfrmvnatdsmniscpsssaysvsgdtvefrnglnsfynmdvsklnssdgkvkninlqys kfhksgtldlknetcyvltveleddkgfnyhsmiisvdsfdkdslsfnkeatvylfdgnnrefvvdtvygsqvvi |
| Contig40_gene_102_3 | 488 | mspyelikdcgevvnlggspdesqdfdvslerlndksladsdgdgkhdvfisystknsdianeicyileknglecwiaprnissgknyvdeia dgikstkivvlvfskyscqeskyvnnevmmafsynkpiisfnidqtepndimgyylkvaqwlpaypnpksqyetlvtdalklcnerprtvitsl dgfipediskqkknwislilllftpiywasfiymglvskkkswtllgflyaiptviglllyfqvftrlfliypifrlfnlifilcwilalihgl virnefltrysvlgimsfdkdlfeylygmyykm |
| Contig40_gene_102_4 | 489 | mshdvficydeedkdcaeaicrifeennikktwirsrdvsskdaarnlteairnskcfvlysknqkntnyiinetdiafskeipiilfkldet sipkdlefiliskkkivayphskrqlktlvketsdildrptddikldsnsvktiersnpkrkennikaigaaliaavlililylfvivptgq nitdsgvfsmdvthvevdelakgnkytiygesynlpsdsdryfmnlqffddkdnvvyevnstadefksgiiwsgdinkgdikhigfkltdmdn kilsqedynlgl |
| Contig40_gene_105_0 | 490 | mglsltisyfnksangeslwapflemfrmlsvvlilityiatksksfkviirgqqsrktiiwqiiifsilgilasyctmdvngipanargliv misallggpyvgipvgiiagvwrygmggitalacgvatimagivgslvyrwndgeflrpykaallmllysgfdmflitiltpqpkgvlianal yapmtfgavlgillftflftekkeeaeksdeqtvsdnrntdtqnineisqelneykdkvkkleqkleeydkkfnqleqklkdk |
| Contig40_gene_105_2 | 491 | mnetikehswiplilvcfatfiialdttfmnvsissvvadintdvstiqtissfytlitasfmilstklqdivgkkkifligagiygvgtita alsantlmlfigwallegiggalmtptavsiisgtyqgekltfalaiesalvaiaaaigplfggvvttyftwrlgfavefiivlivfalqgki pyfeatgskselditgaiisfvglvlfvmgilmltddttfsiaimaaglivlalfalfeikrkrkgnvplldvelikdrnlrvgtllrllvnl amggalfavsvylqsvlalsafntgltllpmtlgllllfaltapklsakinhkilmsigclisiigclilsgqftmatsmlelmpglfvlgagl gfvmalgvdialsrnipgegnnasgivttggtlgqsmgtaiigvlililgiiggisnavdtyvpdqsgnatfehdvyegfqsissindvkaens tiqnivklsig |
| Contig40_gene_105_3 | 492 | mkedtasneeirsrlldgkitgtnmrvlvcamviasvglnmsstaviigamlisplmgsilasayasvtndrpllgkhltgfamqiiisvta aaiffflspvkeptvellartspsfydvliaffgglagiiggtrsdkvstvipgvaiatalmpplctcgysiangrwdmllgagylflincyf iflsssllilsalkipklkeytekewkihkwrmsygilf |
| Contig40_gene_105_6 | 493 | mrdieelkktpglslkrylilfianliglylisfgldftvtnlgrvliffisifnaaiwplvtriymplmvwtfgigallnggvfaffgp yfgldisgwgivlapltialitivlstlmdaeddgtyyqavlreaqtkrkgeikdypgllivedgiaydvlleavekgvmptvksmidnkth ilkkwetdlssqtgasqagilhgnnenitafrwiekennnqmmqcsgvtkvkvleerisdgnllvengasrsnlfsgdtdnvifftskitdl rklyngawfsifsrnpsefarivilviedmvheiysqlkhsilnirprisrgiayiptragtnvfmreintetligdmligdidvaystylgyd eiahhsgvrdedwfalkgmdkqirrliygnkyspreyefviqsdhggtnqatfkqrygqsfedfvkslphetniyakmssnedhfaevyip fkdridkfknrn |

FIG. 9C-281

| | | |
|---|---|---|
| Contig40_gene_107 | 494 | mlapdlgliyvlglifgpygalgvalaivtlnlingftlmetlpfeifftfgvsylgyrlwysgfktdtitkpkldnsyhislflvsiiicgfi ystvqgisfnlifwdrfyimilfyfmsfttmaflygiigiwicnrydcfetpkkskrhvdkriyqaifcmiiitsiilatsfittddttvri lelivlgiflfayltkpfeyditpndkdtisgrimrnfiliitfilgvlgiaismisysaysqsdnvylvlmwgpiitdtvlllflipcifilr yiedkvvqpissfskiegfikenekidedglvktyskytdekteigtlarsytelikhnnyienireiegekerinaeldiatkigesslpe npiktndftvegysipakevggdffdymvddenlaivigdasgkgipaailsmitqfmiknflkqtlnpsevlyslnnqlsennpecmfitl wlgiyntrtkkvrfangghnpplvkedkfkyldidtglvlgitgdfdyineeiilkdelivytdgitdatdedsniygedrlikflnefkgd evpikplisdvntfskgveqfddmtllclklnk |
| Contig40_gene_108 0 | 495 | magniclfvdglivsfligasnlapiqivapvitfvnliywmiglggsvlcsvakaefddeksnsyfsvslislisigvlitvigllfsgsia qflcssqpelvsqvsqyfialvigmpficymmslsyfiradgqipqlpfrailianivnicfdiliyikffnlgitgaalatstgylvgsilisy yffkkertlefiklkanaffkfikkivtsgfssastqlyltlkllvinflvglyvgksgvvafgicynslfilyifligtaqtmspivsvyfk eedysgvdyiikrslkivvasslalsvlfifypqallflysvkdpadvpvvlnalrifaisyvgtaitflytfyaqaiqknrlstiislegf llpisaavilsfaiggngiwisfaiaellltilfifaysrninktngeytgffinkhnddervfeytingnieeavnllqrksqklpylg |
| Contig40_gene_108 3 | 496 | mfnnykdkltgdrkllilfvilaifnialyinifkymvdikdinmavihdfvtincaliilgftstrlpnlkkrdssiyeisyliiglisit isffnksingeslwapylemfrilsvvliltflatktksfkavvrgdrsrktiisqiilcsvlgilasyftmdinglpanaralvvmisgllg gpyigipvgiisgvwrysmggptalacaiatilagitgsiihrwngnefispvkagllmffysgfemflltiltprptglivasnlygpmtfa avlgillsfldekkekaetddgdedkkielmseeleeykikangtegelkeykdkveklegelnelkgki |
| Contig40_gene_109 | 497 | metknliiicvtliilvclglflishmnggeethitiltsqyltegdtlklklcdkdgkgiadqkislkiqskdgnfnddiviktdengesqi qnlqrgnytliakydgtsqyegyglityefivspkevegssktttsttttatsnngdyasdykaddvidgwdpsehevsreylgegeyrvnyddg ysrvidsdgnvlsygy |
| Contig40_gene_110 | 498 | mlyrgykkgmefgkfqyafivclsalficllyslfn |
| Contig40_gene_110 | 499 | mlkklkiiivgdrmdnklflqafskffiglilliicallfipagtlnypngwlflallfipmffagilmflkspellrrrlnadeeeeqkivil isaiifllafilaglnfrgwfkinslliiiiasvifllayimyaevlreneylsrtvevneqnvvdtglygivrhpmytstiflflsmplvl dsifsfivmliypiiiifrikneekleeldgvveyekrvkyrlipylw |
| Contig40_gene_112 5 | 500 | mkvsvvtpnynglkflnayfetlafgsrfieeiiildnastdascdlieeyinspsykidikliknodknlgfapavnqgirlakseliysvnn dvelefntietllqsmersieegknpfsiqskmiqyhnrsliddagdeynllaytkklgdgspidnynekreifsscagaalyrksilekigl fddnffayvedidlsfraqingyrnylepksiiyhygsatsgsrynefkirlaarnnvwmiyknfpiplkivnfififlgffikyifflrkgf gsiylggvkeglrerkgiekthfewknwnyfkiewkmikntfgyfkk |
| Contig40_gene_112 6 | 501 | mrnidlsiivvnyntfkltrdtidsclaepthytyeiflvdnkstddsleklqeyfkseterglkiipnqsndgfakanniaieqakgdfil llnsdtlmkqstidkcmdyitdkghddidalgckvsladgsldkackrsfpnpansfyklfhinvdsdkndynldldlddgiyeidclvgafm lvrrttidevglldaffmygedidwcyrikqagwkivyfgqaeiihykqassedkntkkrnpkiiyefyramyvfykkhytkkynflvniav yigigvllvfnlvrnafrs |

FIG. 9C-282

| | | |
|---|---|---|
| Contig40_gene_112_7 | 502 | mikenqrilnailviidiivilisiglayfvrfkttifsvggslpfsdyfiftivcliptyillyyffglykpfrnqssifsgaedivksdim afiilvailfiinqpnfsrimllllslfgmiltiaervlvlvlrmmrtnnlnlkhmliigdndlafefahkinsktylgyniagflgrkeni gkrfegtkfigsfddlprvlkthkfcdrvviaiplkyyyhlneivdaceeegikaeiipdyykylpakpsvdmlddmpiinlryvplddafnkf kkivsdyfvsivaiiitspimiltaiaikiespgpiifkqerigyngkpfmmykfrsmkvqddeeeksqwttkddprktrigtfirkwsidel pqffnvlkrdmsvvgprperpyfveefkktipkymvkhqvrpgltgalqvngyrgntsikkrieydiryvenwsladvkimfwtvfrrnkna y |
| Contig40_gene_113_0 | 503 | mliamdfriiilsiiimillgvllkkidllkeedvetlnnlviniclpclifnalytadvslipslsilltlsttitslivgvftyillklfaw dnvkiwsilvtvvlgntgflgypitqgiygsegliravfcdcstsitfvilsvlililifdgelkvalrkiatfvplwsivlgilfnifaipit dvgttvvgylgdatiplimisiglsinisglknnlkevslasfikillypfvalgvmallgitgfnhtiglieaamssamiglvlaityklldp hltsdciftstlfglvtiplflmfiv |
| Contig40_gene_114_4 | 504 | mngiyyviaflliwtiaivfkgrlenyglevnfpllmwktqrlrgfidrianraprfwkwymnigivistgfmilmavalvyslktlmdapt vslvipgvevpgspifipflsglialatvlivhefshgilarvekikinsigllfailpgafvepdeeelkglnrpsrmriyvagsmanltl aaialvimnlissfvvpavfeddgivisrltedgnainylsegmvikginnysvsdgasyqkavstlrpnqtvtvltdqgeysfqlksnpqnk slgymgvqaqvnqiispdfdnkfytpllwgimsltdllfwiyflnfavgtfnlipmkpldghlfedllsyitseniykpvvtfmsffmgiii vvslvvgfvgvpf |
| Contig40_gene_115_3 | 505 | mkfdsetslvlvsfltaffavflaagivigvpaianefgmnnvvqnwiitiallvvamftlpagglsgkfgvkrsllvgvlifivgsigacla fsaesflffrviqgiggafsnvasmamvvqaikpqsrgkalgltvtgvylagslspvicgflvynfgwrsmfyftipfflicialmlwkipgd wktyendkidsigymiyavgillfiygftnlinawglicvvvgfilllafayyetrvdtpafnmrlfkntkfassnvaalcsylavaalttil nyhfqyvrgwnaqmsglilivtpiimafmapnsgklsdrihpqklaaigmtiataalvilifldantpiwliivanvlqgvgmglfttpntna imssvppketpnasaagsamrtiggtmslglltlvfawimgslklssqyagmvvqasqivciictliicvvaifaslvgikskdefniekps |
| Contig40_gene_115_4 | 506 | mkldletvvvavsfitsffavflsngivigvpaiaqefamnnviqnwvptiflvvaiftvpagqisgkfgvkkslliggvlvylfasigavls fstesfllfrilqgagvaflnvsamamvvhavkpqnrgkalgftvtgvylatslspvicgflvhnlgwrsmfyfvipflvicvllmafkipge wktyekdkidmigsilygiglafiygfttlttstgliltiaglamlvvfgayelrqkspvfnmnlfknkkftssniaalcsyiavmvttil nyhfqyvrgwnaqtagmiliitpiimaimapnsgklsdkihpqklaaigmsiatvallilltfdgntpiyfvilamilqgigmglfsspmnna imssvppkdaptasasqatmrtiggtmslglltlvfawwmgslplatkyagmvvqasqiicgictvacilaifaslvgvkskdkfntdrpt |
| Contig40_gene_115_6 | 507 | mlfveilknlsvfeilvrkllkkvkntrglvlflvftcffssifitndvsliifvpftilalrkvcrldliifavsmetiaanvgcmvlpiga phnivmymvshipfqsfflilllpyivvsavfliilsffvpsdavnlpkfgkveinkegffkrvlfgvdyfllltfialfvlignienitffnl lfkkwiigneviwgvvasqfisnvpaaillsgfstnyeailivginigglgtliasmanlisykilvrehgefkirylliiftfnvvlflilg vyvfih |
| Contig40_gene_116_1 | 508 | mwllifgnienlilssqgvvqgvdpkilgglsilvvimwfvigtvitdvaiqysnlinfiqqlaifllgfqavyeavrnirqq |
| Contig40_gene_116_2 | 509 | mdwkpyapftallifgnienlilssegviagvnsfvllilsliavvawlllgtygtgnyaikyadyieiiggiaiillglesmleafgil |

FIG. 9C-283

| | | |
|---|---|---|
| Contig40_gene_116 5 | 510 | meikrinryviylfslflislgasisikanlgtspiiclpyvsslilnmsvgtvclifnvifilvqiillrgdferrqylqiivgtifslsid fsmtlvtflnptnyisqfavlmlscvvvafgvllevqtevvflppdgiivaiskvlnkefpkvkpffdtslvltaailsivflgylagvregt iisaviigpivkvlqkffnpyieaviek |
| Contig40_gene_118 3 | 511 | mnfefsilglflllllfvpnliwtkfipkdyenyskrenkilllerigevatvvfalfcgakfswsllllllifilmalyevwiryfmssht mkdmcdsllmiplpgatlpviafflfgiysnsiflvissiliaighigihynhkkqcnln |
| Contig40_gene_118 8 | 512 | msnsqndgledvskgnnesagentdstsnkktrftksksisevfkeldsqetndsildsedaaselesedkysnienylseaeseeeildass eaesldassdvefeediiidstaeeeideiipihneykdldeseafntesideeeisesseldnyvesivnekddlssdelvdskenldavgg degsmsvkdienasfeaedtsldaedyeddsidsedidqsyeeelldenmkvikvnnassedvlskknkgflssfgsikmdssfiitvlsfiv glgilingifylnssdrvvdnvlsgetaglavflliiiglliiigfsilrflsstkadqssmldmfksirdidydvkddnisrddfdsvfss vfgkekrsdfsnddgdkssvdknlfdeddeisdedidalysdsninktasstknstgiqdtdniieedlddfdmidsdnsedfdndtdledd nvsdlkdkyskynfdddddapskpqfkksvdiskfdddglseeeleaerrrkaeeleekkrriiggtnfdnslrk |
| Contig40_gene_119 9 | 513 | meimpiisffigvisilspcilptlpiiagfslkaeskaeivafilglfsiftiiifiltgffttilfryivyvriaaflllimgilmffdyn lsfgsvksrsgegivnsfilgfltsvawadcysgylislitmlvssplyavfnifiyvfgfaltllvlclaiskidlekliyksgyipkifa vliiigafymfytsiqvfl |
| Contig40_gene_120 2 | 514 | meriigvdetaktpayeledgvdypmnkyrallvhflniaglgpifgaigqalfgpsaflwivlgtifaggvhdffegamsvrndglsmpgi iskylgdrvrkffavlliiitcilvasvfasgsadllssltnidihiwlvaifliatlfpvdkiigkiypifgalffimavllisalilnp nyslpefttaglyltdkaifpflfvtiacgaisgfhasqapivarcvknekdmhmvfygamviegilaliwatiamsffhgqpqlasiygssp siavkemsialigtvglvlaiigvvicpitsgdtslrsaritiadelgInqdkiktrlkisiplflvsfgltfidfslvwryfawsqliviaia vllaatvylidnkkhfivtfapaifctvvaiayilgaseglrldpfisnvisvivalalsvyfilkyrkqpnttt |
| Contig40_gene_121 0 | 515 | mlslikdnkgflslidailsiflifivlisfnmivdmenpisednnqfktsqdlmelmsskidgrdystlerisyvlssndnsiasrrevkn ilddffsahlgsdykyvfietnqlngyvlssdgdystadevslairnygnysyklyifka |
| Contig40_gene_121 2 | 516 | meertglfsngviwfgvaisvseieagiqlasmntldsiwlplvlghiiggillfstgligarlrlnametikstfgnygskffstlnvlqli awvavlnaqgasalmglnlpisfplicilsailiavwvyvglrrsskittimmivitallvilsvkllgvhisnalpiqninstalsfwsife isiampiswlpvisdytkdvenpvngtlvsaiaytiaslwmyflgieivgttsiaqsillaglgaqgviilvlstvtsnfvaansagesak aifnrinpkiagvvvsaisailaisgimdhyigflyliasvfapmaavllvsfylskeetgnariwywnifawlagfivygatvnldsiflgp tllavivsailayipilllknksklpnisk |
| Contig40_gene_121 3 | 517 | mnetiktltiqdiscygqcsitvalpvisafgietailpsavisthtsgftdftvrdltedlpeirkhwekegiffdsiytgfiasaeqldyi kdiidsrlkenglvfvdpamadhgefyngfdqefadkmgelcklgdfilpntteacfilhkpwkesftkeemlemakelkaftkryvilkgye eedkmgmividkiedtidivynekinyvshgtgdvfassfvgstmlgkspsaaakiageftkkaiektigdethtgvkfeqaipelydllks i |
| Contig40_gene_121 4 | 518 | mmdwspifismktaslsifitffIgIivawllvkikndttkivldgiftlpivlpptvvgfflIyifgirgpigsffldffavkiafswpatv iaavvmsfplmyrsargafkqvdsnlldagrtlgmsewkilfwkilfanalpgiiisggilayarglgefgatamlagniaggtrtlpmavysev aagnmgtafdyvifivaisfiaifimdyfsirkenqwkn |

FIG. 9C-284

| | | |
|---|---|---|
| Contig40_gene_122_1 | 519 | maqkeldipvdgmhcsscsllveksigkldevesinvdlntnkahmvlkdnlspetidktvesvgftvpkeevviqiagmhcasscvnnvekfl prydgvveananlsnqkvtityyrdmlnlkeiqktiemlgfeyigldgeldimdeeeryqkdlrgklyriivglvfagilmaimhfhitippl tmgqlsliiaifpfcyvsmpilkagwnsfkhknldmdvmysmgilvafvssvlgtfniildssfmfyesavmlpsfltigryleararktss sikeligiqpktatlitsdeegnsiekeidiedinigdillvkpgekipadsivdgesyvdeamitgepvpklkkegidvfsgtinqdgalk ieaqkigsetvlsqiiqlvekaggskppvqrlankivswfipvltiaivfclwyfvagagllfsltclislvlvvacpcslgiatptavtvg vgraaeygiliknqetlesskdvdvcvfdktgtitegkpevadietfdmagdkflqvlssvennsnhpiaksilnrfksdnlkiteegkdda llevsdfenitgkgikanvvvdennssvlagnlklmesegvevtdevldkfntfvseakttivmaidgeikgiitimdkikdnsksaidelhk mgietymltgdnektastvanevgidnvianvlpndkidkvqelqkegkrvlfvgdgindapalsqadvgvamgngtdiamesgdivimegdl envasiqfskkvmtrikenlfwafaynmllvpaaagllflfgivfkpewaglamalssvtvislslllkryvppikrnkv |
| Contig40_gene_122_2 | 520 | migigailflplpidlfyrefnyvygvipplisiilgvifsqqfreydklkfkhgmississwlwaglvgailmmlldvsfvdaffenisaw tgsgltmfsdveslpmsilflrsveqwigglgvviifislllikpgtsafklyksearedrikpniknltlkktmqiyalytvigvillyliaglp lfdsinltfttisaggmsiknanigfyqndivylitiflmilgatsfvthykmaktkgkailkdigfqlllvsilsaiaiaiitklapmdvv fhvvsaitttganiappsemaawappaliiiivlmlmggsgsstvgaiklvrvitllksthlavtnivspgrfvkikisgksinegemkeass ymavyifflaiswiimtyytncpfntlfdvvstlgnvglstgiisgelgtipkvvliflmwlgrleiipillitigifetfngslrfvkrrmm rkikpn |
| Contig40_gene_123_1 | 521 | mgsldtgiigpvlpsiegsfhltsresswiftlfvitfmigspvmakfsdfygrkkifildvlifgigscliaasisieliflgrliggfgcg gifpvagafvgdgfpleergkalgilgsvfgisaigpplvgaalipygwnwcftinipiaifliifawyilpdsdndrklkidyglililsll aiflsyglnqidssnfiaslslsinvlpflvifiilipifikvekkaeesivpihmlknkeisiacietlcygiiyssaifipslvilsmgldd qlaslmlipilganavapilgkildktgskklmamgtmilaiglliaiaiypsnliffiiagcligvglvtliigaplryivlteakpyergag qaivnmlssagqligqaliggiiasftgilgyqvsliiaaivaliafaftlrlkgrdeqiatmkanq |
| Contig40_gene_123_2 | 522 | manenvelmrgapeiavkklaipimismlltasynliidgifvaglgqaaiagigfvtpifmilngvsvglgsgatssisrfvgaknheganks athallifliasiiltiifliqeplirtygasgqslaeglkygsplflgltfmfanggsgilrgegdmkramyavivsviintcldpifiy tlgmgsagaslativssagsaivimywilikkdtwvhvelknfkfdsniakdilkvgipasmdmfmmslavslylifistiggefgiaaftsg qrlylfaimpltsigsavaavagsaygarngdylsrthiygakfgiafgtavtiiliafapqlatifaytpetaplvpeitqflriaslclpl tgagmcssflyggigkgtislmwtiireviftvsatyilgivlgwglvgiwtglaigritasilnftfarftikklrenfgt |
| Contig40_gene_123_9 | 523 | mnisslfsdekvntgrqveldiakafaliifmiflhtvmiveaynvglsptytyiignvlgrpyaavvfmfcmgvgvvyshsqwnlmikrgii lylgllvnvfefflphylagylgvnaeafplfggliifcvdilafaglafilmgiilrkfevsnkamiiiavimslig sfltigidfgipavcs ffghfigakghtafplfnwfifpvagyvwgqyfirakdkreffkywpillivafayffissrywggvfsedvrhlyyflntldavfciinaha figlcywisdylpdsitkffstlsrninieyiaqwfyipvtiilityfskglvfddlvttivsicmliisvtvtalayrklrtkg |
| Contig40_gene_124_0 | 524 | mylisffglgvkltnfndvalfiiifvslinailwpiltrilmpfivlsfgigtlilngllinfcgplfginvegpailiaplamsfvttalst iltiedegsyyrsvyrdaekkrkgevkdypgliiveidglaydvlkeavdkgymptlksmidnthtlrmwetdlssqtgasqagilhgnnedi tafrwiekknnnqmmqcsgvtqvtleerisdgnglivdngasrsnlfsgdtdnviffskilnirklynkawfsvfsnpsnfarivclfiyd mtleliisqikhsvknirprikrgiayiptraatnvfmreintstligdmmvgdidvaystylgydeiahhsgvrdedswyalkgmnkgierli ntnkytprkyefviqsdhggtngatfkqryggsfedyvkslllpkemkmfakmssnedhyaesflpfsrknddllidekdleelgdsevivlasg nlamiyltqwdyrlsieeinkffpelipgiveneyvgfivirsdegdlamgkkkgiynldtgdiiggnplegfgkniarhlkrnssfkytpdil vnsfydcendevcafeelvgshggvggsgskpfilypsgwnvsdeeivgaesiykilkenlkklkeysndntalekecsnde |

FIG. 9C-285

| | | talekeystalee |
|---|---|---|
| Contig40_gene_124_2 | 525 | mdiseiigdaiaypihnikalviymiigiitgilgqasfmglimsltgknalaaggfgilgvlvlligallitgygldivkfgierrddgpgi dlvrqvinavkllivsivyyivpaiiawvlftllgrgiltvlivmiisiifafaefmaicrlakydslgealaigeaigdiskvgviklati iivviamivcfillyyvkinsliggillgifavyltffanraagllysda |
| Contig40_gene_124_9 | 526 | mnmdfsvkdfnvrlrtiriwevvialvvafflgftcdyfgiysgeaeyliffflymmvffaiasigthgfkddiygvfkasnlfkvimivipn mllaffiqqhlagfdamfnninllalpvsdlayeasnpllfleffsaifiapiseelffrgilfnrlkirkgvifgvvvssiifglchfnyp dhlahiiytclfgmclcilylrtdnllinmfahflynllsyvivytpigdliflggpfmdftvlvllfsivfvpayifyfsiklk |
| Contig40_gene_125_0 | 527 | mdfnvtdfnvrlrtiklrellvgiviafilslalliiifpvmdsyddlalmvfvfflfiflyalkgtsglkqdfnklferdnsreilyvlliin mlfaflvlaifstfdayltladsewvsildftptaidpavflfesftsiiiapileelvfrgvlfnrlkirtgilpamlissflfaighefgg mtsafvfgmcmcvlyiktdnilmgmsvhflnnliftvwdifaldaivfqmpvlpltllisisglliiilylylykeigkllae |
| Contig40_gene_125_2 | 528 | mflxygysyrvtkvsvegmingndplpefddvigmfvdgikvclvylgyalvpiiifmvfalvssaiggygesvlmafgsiitllaiigayvm smfgvanmanydgalakafdikelieliqsvgvvrsvgayiglalictaifmivglllffvfgfgiitgtlgsytaaggifiagiilgyflm lfivspyilimqsrvagllynlh |
| Contig40_gene_125_3 | 529 | masitdiikeglkypfndtrkvlilgllifllisglislftqyvvydsmtlmvnaspytsvngmfasippsnsalifslwivtflilftsgyiy dvikyaidgryelpdfgnifailknglrtlivgivysivpalifilgimlmvneasgeavnmfglililfvsfivaifiylieviaishmvend slksafqfseifdiiisnmgwgrfigalifafiviaiismffgmifgaistgigilfdsalvstlvssiltglllspyisialgrmfgsvykea ise |
| Contig40_gene_125_6 | 530 | mdmisilkilialifemilevfemildsfrnyyr |
| Contig40_gene_125_7 | 531 | mllffiykfnsisknsssnfnynsssnrdsnsvnnsslsdafrndlnsifkvskiyhilfivlanilfvsaiyfvlsylgsisiiqfnaplf gdftglgfdvtllylitvvilspiieeflfrgilfrrfnleldnitlailissvlfgichnfggilgailfgicvsilyvksrnvlvpilahf innlisfllaligienfihgnsivialiiiilaiisnfvlfraivlewpksfke |
| Contig40_gene_125_8 | 532 | mlkftgkeirdliisffivialafsilysnrdfngilfififpivaigvgagfifhelghkfaamhygywaeyqlwptglvialvssffgfifaap gavviysgmcksenglvslagpavnivlglifiglilnslgqvtdyngyiialicllgtrinfflatfnllpippldgskvlswnalvwivaf aisvillvvyggylg |
| Contig40_gene_125_9 | 533 | makkddkysmpmsgaglvryfddesvgpkiapeyviatlvilgifcfilrysi |

FIG. 9C-286

| | | |
|---|---|---|
| Contig40_gene_126_7 | 534 | mdalralalicviaihayacsrnfviselvgnlpslnwiiiqfsgntfrigvdlflmlsgalslgrdwkmkdffahrfprivypflfwsillg tiflllsyydsfnvissfdlvsianyfygvfmgiidfakpywyfwmilgiylimpvfnkwilhsdlddllyflffwiitclfdytlgvefpir lsyftspiglvvlgyylrytrriilnnqyfalfliifssllmlvlsalystdthfynfniysilvsmevigvfllfknfykfnlnigffsrpd gffnksvyalarysygiflihnaficvlvhylgntgippvlymiilfvvsllcsvimavlsripylnrvigvk |
| Contig40_gene_127_1 | 535 | msenssfsvdnlviyllllalpiflffvsfmlgrypvapidviktilspifpslavspelnsivftirlpriiaallvgaalsiagasfqgif knplvspdllgvsmgagfgaaiailanagnaliqlsafvfgliavfltfsisktykaggilllvlsgtavsaffnalisgakfmadpydklpq itywlmgslsavnfdklamiiiplvlgiiivmilrwhlnvlsmgdeeagslqlnpsrlrllviiactlvtsaavsisgiigwiglvvphmtri ivgpdhkilipaslsigasflllidnisrtfisieipigiltaligvplflyllrkgysewn |
| Contig40_gene_128_4 | 536 | msmladfeparlhkrtwaerhdveilaviclaisiamlllffalaeptvagvi |
| Contig40_gene_129_9 | 537 | maillplmsmlgigeltqnyilaivsgmialvvwyynekhnsdlvsgttkcdcelcyggddeali |
| Contig40_gene_130_0 | 538 | mittgvvilfnsitehpyfmewdeigivlgivsitiaciyiamidrwkerrkeeldtiedyinrkaeeianmkvlrkleelee |
| Contig40_gene_130_4 | 539 | mgfwglttdcgnllfplgylmadvitevygertarrvillglfanillivattltvympypsywtggayaymfgftprivlagfiaylvggf vnarlmvlikkwtnskylfmrtigstlggelcdscicssiayygivpnsgillfilmqyvvktwevvmqpltyksiawarkdg |
| Contig40_gene_131_5 | 540 | mkaigdnfsvdyllalfssgdlilvaivlnsygvispenvrelvidyisyrkvdifwrhlrrprmsfedyvldnfeemetgeltreqvvefv srqerkgltfcneifiavplkkgskddiveilwneyfvedykenwleqhenlgwndwkkllkkeivenggddfqifrnhlidcvlmey |
| Contig40_gene_132_7 | 541 | mekveqltiekierererteqferaikeakeqfererteqfererkerlerekrekerkiekererklerernkieererrikrnerir renernriksdkrereksseekrikrnerirkanernsikrekrererernvmtideyyrsigygstgkskvwsaiiipllliviciililmfyg ggm |
| Contig40_gene_133_9 | 542 | mlktnfgitkdtltdlgwsgaaddvkgyqealdkalekggdmdgmldttghletlkknfrvagrhvgemftpyidmavqkinglketcpglf enlvmiagavsgfatvapsiapmisvfgdvgsaikrtagflgmevaedavtlkstfltiagiagadaavlqtaansgltasfwamaaailan pltwvavaliaiavavyevgksfgwwsdigsmigavwagigrlwsafinnpnvggflkdlsnawndicealapvidwarkawaelfppsatgs fdivraiidvfgqlgdflgkvvnavksawnalggfagflpmllgpvgmvvmalrmivcillgcspgivpalqktgsvfmsvfgaiaefiggav snvvailtriisaltgiftrvssivstylakmissviswassiviskaksassskfltnvvnyfsklpskvwnhlkniiqkvtswatsivskgkn aaskfltavvnhfsklpgkvgtyvsntasrissgankwvsnarskasstvsavtgpisklpgkvynefmgigsrmlsagsalvskarqigsnl vsgllnamnihspgtiggkvvaefentlsrvgsmdstaldvggsvgnsivrgftdfgldtgsfnadystdynlnrkndnldvnikqelefvf dfknlpndvdedkllemlkemvtdksviqalvsnpdfgsmdtkvknsliakvkrargv |

FIG. 9C-287

| | | |
|---|---|---|
| Contig40_gene_135_2 | 543 | mdlifeylivfiillfatniaflrryssfnknkfipfvlgyaiiivfaltfvfssinlqkesidfipyilfavsalmliisiryvgfgknygind dkvvlygtilssflsigalalglksdnlfslglelailsvvviflvykiskifnnakrpyyavigeymflefilllilaltfssvreldysmf gsflilltptykvlymiiaivillvillgvlyndwvlkrlkrk |
| Contig40_gene_135_3 | 544 | milqgteiltsfihivseslapvvivlvifliyailsfggflnewftkkplksagleklgdisssdspedlkavidasalykeqkeilvki tdnynlgpearkafaskliieeeesnllkltttkdilvrlgpifglgltliplgpplsalgtgdittlagsltiafdtttvtgltigalgyivsk yrkqwyesdlttetiaeailekinqf |
| Contig40_gene_135_4 | 545 | mlrkrkrfsdddgdedpmsgisnlsdamlvlalglifaimalqvnpdmmaktqesqaqqatsqvstgqdfnssanagasleqsgysevgkvyk dpdtgklvmvqg |
| Contig40_gene_135_6 | 546 | msfkspadtakavasaatakgempiiklailgflagayiafggllaevantgaiaggvpvgisklifgavfpvglimvvicgselftgdvmfm tmglldgktdimgllknwgswvfnlligglfvayvlayltgimvpeafaggaitiantkalggatfmaagkstasltwvqcflrgigcnwlvc lavylanaaddvvgkffgiwfpimafvcigfehsvanmffiplglifigaevtwaqffinnlipvtlgnivgaavfvacaywfvylrd |
| Contig40_gene_137_8 | 547 | malniasvvdasfvstfighnaqaalqvleplvlilitifewlfglgqqilalnkkaefdeggsnhyfttamlativlsvlillvcflfkdsli nllhptagalpyvnayspylfisfpiatilgvlcqfirvdgqpnfasgviivaninilldylflgvfhmgiegaslammigyavglictlky hfdskrtfrfvfselkfgtwirstieiikiglpgasmgffnvlliyimnlivgvlgelgldifnvcvvallisilimgfaetlssivpiyy aqndfynlhhivrnsiiitlvcsviftafllivpdglimfkklhqtandglvenairivslafipmafstmlifyyegiertvesgiitvise flgplfftyllypfigitsvwlsfplgfilsivavsiyvkvverkdseysglffirrgliektrnytleskndavksemfnhlkslnvddssi etldkiigtifdsnnekvhveilllidygdkivinmkdegnrevmkdieksfsqdkikvsevlgfnnveylidga |
| Contig45_gene_1 | 548 | mniiknlplaitglilailsiqlkifadfsaiffiigsilifmvllkivfhfndffnelnnliplstfgtfsmalmlwstylkplflplsqdia fviwilgiiiihlsiilifftnnyvlnnfniedvyatwwivyigitmaaitapahglskygfiffgigfilmiptlvlvsyryinfkqiddqnkp ficiyaailsilivgyvnamtingtflsliyigavifyifailiqafkfiliierlkfmpsfsafttpfvisaiatgeaykffgldilnylfyiq afialilvifvlynylkflmn |
| Contig45_gene_10 | 549 | mneqtklskdhymifglswagwvfdfydlvlftflisqlqsslhinaemlalclglsilfatglgglifagvgrkkvlewtilvysigtl lcafswsfyslvlfrfitglgvggewatgqiyisetfpdnlrakfgafmqsgapvgvilasivggmispiigwrmtflvsiipaitililrry lkesdwiknkddfvnknifgefkqlvskeyrkiflislvlcifgmsaywftyswiptylaeerglamvttslgililiqcgdftgyttfgfva erigrrpaftiysfimgisiamiticwnqidkvpdlimvfmfltgfgfggfgslfselfptkirntgvtvfnlargvqfitpmiltfvg ayydlsygiaiaaifaflvgiwiwvfpetkgtaindld |
| Contig45_gene_29 | 550 | mannsvlrrivsliitkhnilsigtkyfpttteleteyvdmfnytqtmimeidkanittesiftnlvrdvgrenipenhsfyellpaqnkideya lvskiimgsdrymyvelsepsyiidyftdiilrengelierseteivsrlmskndairiaiklvgiglidnnirvraaagmtgaaaierskfn kevgdvpgvaftklggeyalvldtpfklgqsehaeyqhylfidivdstnfiskhgknklvelmtsvkefmenceghiegyreggddliarfps kgvairagldcawfilnngakvkigigrsrreageraniaegikgfgaltlivfdlanglyayyvpsdfsrticelfttkkgklvtafllvfi lcyllavlgfglygilvfiivvayytlk |
| Contig45_gene_38 | 551 | mrkvfesiiealkypfrdwkniivigflllliaslgrklpfpedpqqtvvfigallilflqtgygskivysglkgenippklrpipkliwegfk kililiyvhimvifisvgktqlsannipialiflvlggtylimvggllnryfhhgkfikafylkeilailkkigfwdmisivicamisqtl tistfinlvkgmftsielvlciiafflapialmstkrlislnlrrilssdedlekfaf |

FIG. 9C-288

| | | |
|---|---|---|
| Contig45_gene_52 | 552 | mdyllitlkcdkmdlnyiivlfvlltflatvaftyfvrhtlrdadvsdspivsehrhkagtptmggiaflfaillfivsiyyrntniliasfiml tggvmglldellglkikeyqkvvknvsdsvvpiglldlgpgeearvttdkakkqvygyvdegkleivaeipikyepsektkiivqllpglfla ltgvvttlggftlgilaypicliailgsinsinlidgmdglaagivaiasfscciyayicgnmdipafailtgiclglfvnrypasifmgd tgsfvlgtgyavavilgdipyfgvlalavpivsviislmhrahiinlpveplhhtlnykgisevkivlsywlltvlvcaigilaklyifa |
| Contig45_gene_67 | 553 | mfnpiialsyissgffmkisddeydeknnkilailfgivcgaftalassmstdaacifiailignilaqkvdgihhvtmlsfliviflglp afsrpsilvvmicvagalidekgndneilyekskflmyffdyrfalkvvilalalfglvdiwtfvyflcfeiayeiarvlfekfil |
| Contig45_gene_72 | 554 | mndiklklyvllailiviyvginfsyngldtintlthvnldlgpsmdnandanhikigsssftklskiftw |
| Contig45_gene_83 | 555 | malieknelflleeivkknfaakykdsilgifwsilkplliimilltiifsnlfggsienypvyflsgkiifdffnsatsvsmmslkgninilk rtaapkhiftlagvvseflnflitliliilgvmivtrspfyilesmiaiipimsliimitgislilavlcvyfsdiqhlwgvitlmlmyasaif ypmniipepfhgimilnpifwviggfrilvlwgtipsrmmnlnlvllsviilvfgiilvfkkfkkitlkf |
| Contig45_gene_96 | 556 | mvrkkarrrkrqeedpmagttnlvdamlvlalgflifavigwnlqsvifsdmdpqergatmesinqitnvtgqeqlnstpdtsnqsgegyveq gkvykdsktgnlimvet |
| Contig45_gene_97 | 557 | melifsvfavislaaillgielglsksffnlslkkhlilvlaysiiifaviviispsyeavlnstfysfyyyiimgfvclalglltlfywsk mewyppalkcllyfdfvpislslmlistalmapsfafkvqnfslnltmvnsglilvlmailmvifylfsdfvedyrvthyailigslllifa layfvlgfiipnmapvfanpsteltlmpiesivvmvvliallilglagalfrkrtnrle |
| Contig45_gene_98 | 558 | miilamtipggdfilttgnlinlisqsllipvviillvfvvvvislgliyeytsrtkvsvddvsnlileisdsgsvdsmksaianspipklqkd illkiastgnmspntreafarklieneegltdksleitdiitrgptlglmgtliplgtglaalgsgdvntleslivafdttvvgisgala yviskirnrwyeeylsnldvlsdavldfmakh |
| Contig45_gene_99 | 559 | mglslyllldilllitftlvfkiennlyyiliaidtilcviliyefynrfktaenkihfsirnsteilagipidlilflpfapnltvfltifnll kflkiglfleffetidvflkkthldeilglailvilvstlgiylyfdpsinsifdslwfvlstittvgygdvlpnsyigkvigililifgvli fsaitgamtsyfarkvfatkdfnitendnirllkedlsfnkknlnnanekidkinndveklkrelnemkeelresrqlnkelkeeivlnen lknk |
| Contig45_gene_114 | 560 | mllheqafqligesivvlvvllililililililgilllrrnklvfspliifvvnvfyspikslanflrlddalvdhigievrnkvnkpkfdqip peekiivlphclrsrdceaslkesgikctfcgkcaigtikskaepmgykvfivpgssfvkkiieqnkfksvvgvachvdlnqtmmalsdfypq gvllstsgcfetrvdvskvlstigyyeykeknksiddekddssedigrikps |
| Contig45_gene_143 | 561 | mfnlkdmilifirgflmgsadtipgvsggtialitgiyerlihaissikfgfikpliildfagfkeklfeeidfelfiplvlgiavltls kvirvllqnytaytfsflglilasayilytkldeiniklliiltigiilsyifvglnpiaanhslivlffsgmiaicamilpgisgsflll lgqyaymldslnslnfteiifiagafigilgfskilnyllenyesatmafligimigtlrlpfnqitsnltgswlicliailigvvllvle kkls |
| Contig45_gene_146 | 562 | mkgtwklklrlwlsmavmfglvyvlimlagnflgyrgfygfyaiaglfvlfqyifgpkivessmgvhylseseapelhqmvaelaqaanipk pkvgisntmvpnafaygrskrsghvcvtkgilglidhdelkavlgheishikhndmaittvvsaiplicyylgfslifsgggdnnggali gflaliayflgqlivlifisrvreyyadagsvelgcqpeklasalyklvygaaripeqeikdvegtkaffltdisnarneindlsqldfnrdgv iskeeldqlknnnvkisgsnkimemlsthpdmlkrikrladmn |

FIG. 9C-289

| | | |
|---|---|---|
| Contig45_gene_150 | 563 | mkkmicpkcntvnddnekfckncglqlnttricpncntankpnskfchkcgttlspvdtfkkgiieentsnsffstykipiicalvillaiga vtgvaifggdgnnginsiiplandtyddtnlnnygvnhdnvsqtqsdnftenqtdnltdnqtvnqtvenktktatvqnqtdnnktsnndtnkt kvysektnttnssakvntektkcn |
| Contig47_gene_1 | 564 | mkhrlnldkkdpnyillkeifkimdsreskqilvsygfknlnrtifafkiifismffeidipfilnelksnrrlckflnisevltadqvykif seinsekliksInrilnsrnmvkrrgkktfivdatpvdldinfrrnkkskehlkklklnlkwsysskgyyigfkatvvmdydsmnpvcillhsg apndaglfeeilenlqkrriirkgdtlifdkgyygyknyqigiskykiipfifpkekfsrtlrlddiltyplavfnktkrimeekrlynnlkxe liekidswekfkpirgkiedffkllkqglnmreihkytlksvektvylnvflgaliisgqfyskttiqqlsen |
| Contig47_gene_12 | 565 | migddcffmqnadyhygasdsekmygrgydgssdyvprysggsygsssgaessedgslgkycligilivlgivvfanigipaitnslsssvt vddlnitryiysnqynskittdygyqitykersygqhatnvifyskngkvlyndsqymgtcylgevpyiiyfdgkadyaifevyktqfdsgec iyrervdvdnknvikefinydtlydd |
| Contig47_gene_21 | 566 | maelmckifvvigyilailfpivgiivgallyflkkedafyqthgkyilivgiamiainilliafgiitippvgqv |
| Contig47_gene_22 | 567 | mdnrnililiigiiivliaaagiiilvmltsenyermeivpngtsidvplnkttydgefqsarvwhwdkgilvtynshedknilrvselgiytlnk iietgekenidgftsyvinadeileielfdaiklhytgkfyciplangttgdviiicsndreavhmaksiqyknvfpvnsdfnntietvenl seylestvndyanstdfdnavstvenltgnlessakdyvndanlsdvkttveektginiddaksdleqyigklts |
| Contig47_gene_26 | 568 | mpldiiediwkyttnnktfllililvlfylfcmfmqifdemrisyalylsmipyifiagygmaitkdvidngkrlpkilikdvivligkstvvf ivylsvqgiffslvsylcnfpiidvedilldffetaplIfhhnlvntlifivvdfavfyftmffmemglakladtgrfldafnlikkiidi igwrlyakhytvviifllwvfslllidvetpffvldyifkvfglllifitqywgigavyriykiktn |
| Contig47_gene_35 | 569 | mdirkvigiliiliglifaiypvysaqavswiagvaliafgigilildgfsiwsmmagvsaakillgiiaaiigfmflykvdalsfiiayqfyi igfilifvgllgiifiaidgisrataiItlilgliicicicaffslsqplytavivgicmimegitflasgiide |
| Contig47_gene_36 | 570 | mdketkerlgeiraamkkygfdkilgesaknrirgkdeeeeslIldsevpvkfrimlqelgttfiklgqlIstrpdmvgedianelanlqddn paisyeqvkaiverelegdidelfaefshehlatasigqvheatlntgehvavkiqkegitdkidldirimkyianradrlsgelkkvnlpgv meefdrsihkeidyynefmnmqriemnfvdnpnvhipatypkycttkvltmefiagaklndvyasegdefdkkllaktvidsylgqllidgff hgdphpgnimilednvlcyldlgnmgtfdedfkrnlaeaillimdqdidgvinqlmymdildydidtkplkrdlndlfgryfgvdlnrfdgil gdllklmqeygvvlpnelvtmargvsmveaiahnldpeidifeslkpiakriarerldpkrylkskksniilyehmfralpqlltrtvhkien eelqfrfevditdkvsivalvsalivgssvvsfgprafdmpvisigyliailisivgirkfvlk |
| Contig47_gene_37 | 571 | mteidwfkfedrdydfpfyknphiskmgwlvlffvfiigsilsmsdklsysilccivfivpvlyfldwdykaifrkpslkdialavalfigy liyaiimgailesvgivssgiidpgsidwtvliksvfslmgeefikflpfifflrvlykytdnrklsvvisvalvmamfaslhaynwvmfiya lfiqgfgsifeffayiktkniivsyithyctdafifamlllglg |
| Contig47_gene_41 | 572 | micpscgsenkegskfckncgerltdssrptstnasasasqsksnknlliicatliicvavvagailfmsgqstdyevasgeatndhssalns ydssnsndesqddsasasedssdsadeynknhkwgksfqeaseyfpeasetvvthvfyeadidgngfltdnefkdfkslvsftrkyaadvtnn dyvdtpdlwegdgsvrtrycadhgriavgsddrcpycakkgqdsrtrsgstryv |
| Contig47_gene_46 | 573 | mskkedncqiddcssgtcapvspfskegilflifiivlfivlffllwtngli |

FIG. 9C-290

| | | |
|---|---|---|
| Contig47_gene_58 | 574 | mtklikrevkreyneesplklkianaistftnppiiciciplfllisfvlasngnpfsssfsfdwmlfakceiislvfasvlpmaiiiywakkln tdkdisnredrfiplivgvlsyligfvisfffelpnfltilllcyavntfivmlitslwkisihttglsgpvaalimlgpigalfglllypvl iwsrvtlkkhtmagaiaggifgfvftvgesylymrlfkmsvpglvplaecfwiifalvacpivlgiclllekrgiesviraklfhllafigfa afyfygpssavlillsaivsvlvtifagdtfswykgisrglerenlsivlslacgliwiyvamnyfniesaiiativafvgaiaepvaiky arykfpmksllgndgnksiessvvalivtmiilllftqnvfvsiavgllvclietfvpkelenlvipvacaiilgfllhy |
| Contig47_gene_65 | 575 | mkervcspdceekvlemnqknirksrimlfavivvfilvwayfmffk |
| Contig47_gene_67 | 576 | mpsekvkefneslktkegrdkffkqifciaigtvvgvatyafclyfnlaifgwniglalspltagyaesilakkilnestgaisafilfiitv vygffisnstlgfniitagsavviiqaamptatnyllavgviltytgflkklhsalykgykkifkrepkraeryyqkqasqvhafydenl dinslgvlimtleyppkelniieqkgiyetrhifgskqkediksgledsleeevinrvklardktlvklikevkadgcnglmlhttyetlgt ekgdhiaqvvmrgtgiviekeeeey |
| Contig47_gene_68 | 577 | mvplqfflftsvgvdpslammvslgtslailiptassgayhqkknksivrpgirlavfgligggfcgllanmvptrilqmifacllifvald mlfgsrsdgekalidfnllnggivgfsigiisgllqvgggvflipslcilfgfslieaigtssvfiaftaigglisyiytgfgvnpmpyclgy vslinfvvilfsvpmatigaklvyklpekrlkqifaililymaikmlgfdpisilgl |
| Contig47_gene_69 | 578 | mnlkinkyipfgiliilggslyflsgidqfirpftqpilmgsskgkdilffvlfgitilissigdnerihnylmnlsipeklkdkdfylkls lilflitaisglavelylraslqlnwntilvimmpsltstsflnshlyksiflgilglfilshipagihtgsslssyapsvisllfilipityi smvlsnqrrkaasrillaftstlgiigligglfatpaiggiygililmyneeildgisdfitekdkrdgikeklneelraiksifnnknikk ylkialphialiliiilrfsvafygacpdsyeliisnghdldldeydtlnisengdrtvvhlsnqynemelfk |
| Contig47_gene_79 | 579 | mvkisrknsfdesseedpmsgvanlvdamlviavgllvflviswnmqsiifnedlspqqkqeaidamnqvievdqgqlnetpdisnssgegy temqkvyqdpktgklimien |
| Contig47_gene_80 | 580 | mgggiltyildtlsqslqipviifllifavgaililllggllireyshrktisdaemrniidainkandkseilsivdssdipnsqktvlreitds dwdnesrvglakklissrekrlekrlsytdiitrigptlgimgtllipmgpglaalgtgdvvtlsnaiivafdttvvgigsgalayviskirrr wyseyinnidvltdvvlnklnkl |
| Contig47_gene_81 | 581 | mgendrsclnscsslkyslgdknknndldnsadlnslnpnsnnclnsnknnncnycykngtdlnddlndsdncpdsfakktninhdqlndgeid fsernnqiflispenfsvffdennrlkedyggctlvfegdfaelgliidisypytritakensfkntafklsasdielsnlnisldkefkdney agilvlsdyisiynitlnytvpantngfciyskgegfrritdlslinntitftgnnlneawdygifldktdnalvygnslgsyilplcednwyn neygavskmssagfvagscndikssneintyvtdstqssfamdsciylydcsdltverntlyledisqdgknntlhgfdlylcddaiiafnn idlftmggndgrkitsplqvngpsdhniriayynnitssnfgsncgiyshnfygdthleiisnfidvagfansgewslsgievqdsddviwnnt iivtnlgdfkynnkvygisysqnrnnynstfnvqynnittngyyavylgkddypvvnstvknnvintyitgnpavsiandnknnpivnntdn efkniknssfpkwlknflrqdtkvdkdfswitdainpqsngtgfsndtgnqtgliddndgsdtvqnnsegsdsivngstsangtgngtsgnat epqnpiddnggdnsggsssdnstgsqtdnedsnqnntdptdskptnnntdvpvnptntsdkpvnstepvpandtepvpandtgpv pdnktdnpvnntepvqedanktdsdntepinttkdnsteiinktesdddtnqtvlkdddldpkeshensqddnknpsddeekstpgdsgnelt dpesnsespqngeensensnddssepssstvgdshsdsasspglsdasssknayeldkpvedlvtksvdyislagicivtllilfgykrqkd ieged |

FIG. 9C-291

| | | |
|---|---|---|
| Contig47_gene_86 | 582 | madeiatiisslglslsneaflaivllafvvigaiivivatrpildvypylhpnarvrarkgrlfdekqiselveannvdeitnylrgspdyady ldnytlekaldiqlgetydmvsrmapkeiqssfkvmakksdinniksllltakqaglneeatadlliptgslyedierltdadgvtgvvagldg teyapvleealpeyektgmvlplesaldkyylskllassetpsdenkqilysyvgnqvdvaniklilrakadgldyeaispymidsgyqlrew klkdlmeaaedvtgvisglegtkysdvlvevlpeynetgsvalfekaldkfIvdsaksysmkkplgigppiigflsqkevevnlkviarakrea dfpiskiremlv |
| Contig47_gene_88 | 583 | mveialgtalaaigagvaigfaglgsglgqmaaagsvgavaedndmfargiifsalpetqaiygfliailllvfsgllgggelstttagiva igvgasigfaglgsgmggmaaassvgaivedndmfargiifsalpetqaiygfliaillmvfggilg |
| Contig47_gene_89 | 584 | mrklnvitldkyagptvsalhdegivglnndiseriqqdpklaellkpskvtpytgkissllmktsalsdligdalseggslkdtlmsfispdl pvpkevedvdtesfiayaestlsqveaetkgiedklaaldseesklesnkslasklknldmdlallsdskytstivgritaesaqkfkseysk itedlfyelvpddekeynilvvvvanefkddiytllrknefkefetedlqgrpdslisscesrqiaiesersqakadlkvvaekwddevlalk eqlenekeknevfatfaedtktvvleawwpeknleqaqsiiietatdghvimeteevpdnaedvplqenctyakpyellvemysplkyneidp tlfvaitypffgfcltdagygilvaligfilyrgmgkvvnrtmhdgglliiasgiwsiilglftngflgdmwtriilglpalptvidsinafk fpatilviavigiiylytnigffilgaidnlrygekkeaigsqivwfvfelgiilllglflptfgmigmalgavlliaalgmliwangayglmd vfgfmgdvlsyarllalclatgqiamtvniltnmvndmipfvgivlaiifigghianflfqvlgagvnalrlnyveffsqfymggknsyqaf kakrqftkvkk |
| Contig47_gene_91 | 585 | mrkiillafsallillglwnymsvpkpgldiiasslvlvavgwtlamsvfepnwikaaifidglvfvlvsitflvspinyvflifgiilvaia vlaylrklpdnilryfyrs |
| Contig47_gene_92 | 586 | mkpkivrardkevmnqlaklfeeskytvksqdknyvllkknnygnplihlpfiliglffnafailvnvayfaysvfkksnvilitteknded nplefddvgeievfydqetwdkaielsrle |
| Contig47_gene_99 | 587 | maigvkeikitdtisilllpliyalviglalylakpikfigrkqskvaegamvlfigvliitkaissgqaiasifqvgpalliqqignlgtli alpialffgfrrevigmtssicrepnlgviidkygfkspetrgvlavfvigsilgtpfisflssisaslipmhpyayamasgvgsasmnaaal aplmhmfpsmatdleafagcsnlsfcfgiymcifvslplaermykwlsphighdkeetiddeyaiegvkhdkyaskeelssgkikrwatfli ifsftvavgnyigyhtslldsfigmiiisllitilgmsleriipwniqsiiyislgiivaipgmptadfivryvvsqidlttictaflayvgia igndweefkkigwrgiiitlivisgtylcsagiahltlvatgmv |
| Contig47_gene_100 | 588 | meittkrkttmwrlysfhgglflialsvfslngced |
| Contig47_gene_103 | 589 | mknhaisrkefkerridmelnskhytililiaiiiavimtymtgiknpiiiglcilaiivilanlyltklkk |
| Contig47_gene_116 | 590 | mfvedlinnlsnfiesrlsdkililflqeyflkagiftlasqiialifisivftlilalmiallaifiplIsfilfvfikser rreelensipdflrqlasmlrvgmslenalvdlsehgnplydelrrvveirmgksfdesfrnmakrldskdlersfkiilnahksggglad visdvsddlramllilkrerkssvmmsimflvlasvvaapfalgmvgvyssfmielnrssaicqlaptvaliylliihsilagflialimygdik kgvkfsipitalaffifyliinvfglsffgf |
| Contig47_gene_123 | 591 | mkmeiikrigigafvgcfvmlvmvlgtyslgpqnvsfsgteiinaffgsivvgwafafsgliyekediplpiqvifqmvigltlfavavyl gwmpislglgpiiitwiviaiafaavfwlgfylyytflardinkkielsndfd |

FIG. 9C-292

| | | |
|---|---|---|
| Contig47_gene_125 | 592 | mdkkmivsvaflllilavalvsvfdesnssseskvnlivysegpkslselvneiktqdyyegydnetvawmeslgnkkfyygdgiivimsatda sklpslyvtdvelfehfecnvlekrslgnveypkdvlyvknvkyigeeygnfsga |
| Contig47_gene_127 | 593 | mkgnilknideiiksdfksafsnpivvvligiiilpslyavlniyacwdpygntdevvfaianldngstfkgdyinignelvtefknnndfk wtfvseenlrtgvfngtyyagivipknlsenvvsiatdnpkqakleyvvnvktnpvaskltdsaanriymalnakivkiidlaayeklgelqk glasgsqqlssggyqlqsgsaqissgshqvssgakqvkdgkqqvstgaetvksasdldegaqtvqegsnyinqkseelqqgsdevqaaadps lmpdgpvkdydvasvelangsgelakgsqlangsvqlangsvqladgsvqladgsvlaagaqllssyavqalftass slgatanelgsvtginktlignylyapialereemfsvpdygsdiapfyivlsmwvgailtcvmlktgstgtkysalemyggklvifvilsi lqacvtiigcnilgihivnplflfscilvsvvfmilvysiisalgqvgkaiavvllvlqisatggiypiqimhgffqtlysympmtygitlv reaqlgtvwsnywpalailfaigiitvvallikvkadkashyfekrleesglf |
| Contig47_gene_147 | 594 | mldipkedpqvrrfiklvkeegsyekaleevgadyiderdweyfgfnqregdyrdfynlrhppkehylsgsnsssgsssnkrqsskwddlk cymsvlgpllilifaiailwgvfkgg |
| Contig47_gene_150 | 595 | mtlpgasiglaelfdpdwsllynysiwmaafgqiffslslgmgagftfasytkrdidlissglcvvlanslfenfaalgvfsilgymslesgv avsklvsqgttlifvaypkvfnilggvalilgplfffvyvagvtsilssfevlsisiqdkfafsrkkattalcivgglasmvfatsaggyll siadifvnnimvlfsvivqtilfawvfkaerlvdffnaksrflklgrwwlilvkyicpilltviwigelynlikmgstefvviliaillli fafiftirpaktdewfkteerik |
| Contig47_gene_151 | 596 | manenewgsnlafvlamigsavglgniwrypypyvlysnggafyipyliailvlaipliileygvvynyksfkaivkikpklefygwilpvv tfimtiyystilgwdgiyfilsffkgwgsdpntfltvsllqsadsisgilnfipviaismifiwliiwfishrnldeglgrvaryfvpnaffg yk |
| Contig47_gene_154 | 597 | mpnqmlkgsvryctenktlfivfiqflfecitnkvggimkttsvivllvilgyglkvtqdvinggtslpkislkellnfgvkgtivytfyl tigaslglglislamnfpefeleeminlhetielffehdpisfilfiilgliivgtiffmeialailadgetlkaafdfkrikrtvetigwk eyaedytkivaavvilvfingyfhsygwisiiigvltdilaftveyrgigniyrgykqkingetaledtsn |
| Contig47_gene_157 | 598 | mvvqehicineekiqehslqlkslesdadfkdkrmdelyrkidkieekldvlnnninnfllrnsqenkkmeirltkietdiqnqklesqrria rmgialtaitiliniyfkimh |
| Contig47_gene_163 | 599 | mreihkytpksvektvylnvflgaliisggfysktiqglsen |
| Contig47_gene_165 | 600 | mkhrlnldnkdpnyillkeifkimdsrksksilasygfknlnrtiftfkiifismffgidipfilnekskkelrkyfniseviadgvykif seinseklikclnrilnsrnmvkrrgkktfivdatpvdvdinfhrnkktkehlekinlkwsysskgyyigfkatvvldydsmnpvcilvhsg apndaklfeeilenlgkrriirkgdtlifdkgyys |
| Contig47_gene_166 | 601 | mnealtklldlmqdynvilpnefvsmargismiesvattldpkidvmasiepivkevmeermnikeslsnkkgslvyyknmlktlppltnsv hkinngdmklrfeidridhivskfslvviiaallmsssitmtinrgpmlfdmpliavlgyivtfilgaiavanyiysr |
| Contig47_gene_172 | 602 | mtttewlyqillnlldlstiisivliiiaaaiiiikgeksllriekkyeinltahyllkdilkygiiiialalilnligidlqnillsgivs ivigfaskdivsnfisgifvigdknvqvgetieidgrkgaitkvgfrnttmigmdnfkvtipnsvlstktyknfpmgedyrlrdvilphgfd ifeykqkmteamekyeyinkdkepvilareineegskveisfwindykdrdpgkavileesnkliydylmdeknagilrivk |

FIG. 9C-293

| | | |
|---|---|---|
| Contig47_gene_174 | 603 | misketfdkdkanfkgtyrpllkeidnptllqidelhgiagalsgknqnihnnlillasigtlitliffiyfewdisafiipcvllmfilig<br>ihlvsnklnyhdkyleyrvlaeslrlqfflsyagaqekvidilpwfiehgvplvkevlgtldftelpqkreirdnwiihqkkyhegalqkskk<br>kmrtqkivtyasitvtiatyilalifeylipastfnlngdiihlgiklamagmsaftlflgsyygkmslsekiddhermvelygiiedrirte<br>getdeilsyaarefllenstwyayqsknkpdlvv |
| Contig47_gene_179 | 604 | memnenvemitgdpkkainklawpliasmllifinniidsiwvaglgpdplaaigyvtplfmvlvgfgngigagatslisryigaekrddann<br>aaihsailsvvvslvltvialllieslklmgagsvlkyamdygvliflftapilippifggafraegdikratvpialvavinmildpifmy<br>vfgwgisgaafatglapcfglcmmlywifikkdtylsynrkdfhnnlnmykdilvvgipasleqlimaalavtvnymltlvsgsvavavytag<br>wriislgllpaigvgtaaitvtgvaygakkyenirtacrysvklglissilvcllliffadqiayifsyseasahllpliagfiqlmclfily<br>vpfgatagnvfgglgkgttsfvlttfrefvlvlvfayllgfvfhmgetgiyygmliggfigsviaygyieyyvdrlikgkvkgsdi |
| Contig47_gene_181 | 605 | mdfistlliaialamdafsvsltkgftlknltksqalwfgiffggfqalmpvlgwlggiqlewlittfapwvafillligsnmireslsgde<br>edekdsdkfsfkeltllaiatsidafavgityavlkvdilipliimigvvafiftiiglylgkkignyfgdkfeivggvililgvkilleglg<br>ilvl |
| Contig47_gene_185 | 606 | msstntavenkqereeaflkqtskpsfsktategfkqkdkgiknpatkynmpkkeetvdakakeapkreapkkeikrespkkevkkeapkkei<br>kpnivkksdegssgginlkkigiiaililliagiglnqmqttdevmnytdgiinftysgnwsvynntnadsnmtdlafktkdktligf<br>ttiqsdeityekilsdvndtahslngeileygevnvggvpaqeiiistqdggysrylcilhdgvyycfvannaksdnqnltslntteiqnmin<br>sisfkdvvagdtanldtsyqessyqeesydnynyedtsny |
| Contig47_gene_187 | 607 | mifaaifavgilrdkivhklnffvnpqnylpeeeiqtlkqvyyllililvccilnfffdnniilpnspefyvfnsfldiivsvyiailiyd<br>gskkskilliflipipsiafllfgeslieywdfvripallyimkifydkfhiytdkynleksilllfsivfisfiiiltvaenedplnalvmvs<br>naftskgytilgestigkidsiflvwggyiisgaatatltaaililkhfnakiekfdekfeeleklise |
| Contig47_gene_190 | 608 | mylefwiilailiigelltggfyllsiglglslaaaifnyfqfsitiqivafilvtvifiilsrplfnrlnrntidkksnterligingeame<br>digqknigaisikgevwkaisdeeiskgeevkiiigidgvklkvekl |
| Contig47_gene_191 | 609 | nmdliyilililiaiiayksikiiirpyekgvverglvkynrtverglnivipfietirkvdlreqvvdvppqevitkdntvvvdcvifcevid<br>afnavynvvnfyqaitklaqtnlrniigdleldqtltsremintelretldvatdkwgtkvvrveiqrieppkdiveamskqmkaermkrati<br>lesegykeseikkaegdkqskilaaqaeaeaikqvadankygeiaiaegkarateitynaihagnptndliaikylealeniadgratkiflp<br>tevsgilgsvggiaelfkddpealekfesikvlenaketadne |
| Contig47_gene_192 | 610 | mggekmakmnaviligfilltlvvylffgryefwglliivgfivgyiahegilggmwnaalagafgtiisailfiillvtliggtammgflgglagft<br>vsgitslidivftiikymivmgitgavggalsgeke |
| Contig47_gene_193 | 611 | mvdaekakqpkerknknsnlpdidfkalifgaaayaffplvayqynldilmvfaaigplyigytaktelksiilgivgatpllylafsgmlgs<br>ygsgemadiimtvgilgalmgyfggylyrdrqrnkakaggivvedtpkkekqfedtgsvkknvanlflpksrrk |
| Contig47_gene_209 | 612 | maigvkeiritdtisvlllpliyalimglalflakpikfigkkgskvaegamvlifigvlliakialssgqsidiifnvgpsliliqliqdlgtli<br>alpvalilgfrrevigmassicrepnlgviiidkygfkspetrgvlaifvigsiigtpfisflssicislipyhpyafamasgigsasmnaaal<br>vplvhmypamatqleafagcsnilsfclgiymcifislpiaeklykwlspiligkgegrtiddeyaiegvkddkyatsedlssgkierwvtflv<br>lfsiigtvgnfigyhtplidvfigmliisiitllligmcleriipwdipsiiyislllgiflaipgvptsdiiiityvsqielttictaflayvgia<br>igndweefkkigwkgiiiaiiivisgtylgsasianlvlfvtgmi |

FIG. 9C-294

| | | |
|---|---|---|
| Contig47_gene_212 | 613 | mkhrlnldnkdpnyillkeifkimdsrksksilasygfknlnrtiftfkiififismffgidipfilnelkskkelrkyfnisevltadqvykif seinseklikclnrilnsrnmvkrrgkktfivdatpvdvdinfhrnkktkehlekinlkwsysskgyyigfkatvvldydsmnpvcilvhsg apndaklfeeilenlqkrriirkgdtlifdkgyysyknyqigiskykipkfsrtlddiltyplavfnktkrimkekrlynslkwe lmkkidswekfkpirgkiedffkllkgglnmreihkytpksvektvylnvflgalliisgfysktaigglsen |
| Contig47_gene_219 | 614 | mfvislipyltifvannpnsllseslygldfilvdiilfimsrylikinenseylsevldlknaiiipfiflliigfiigflgypiaisvcli tivrsilysik |
| Contig47_gene_220 | 615 | mkmenlmetnrleafydaiiaiivtvlvlelpqpetatiagilalkvsyftylvsflvcqslaispldicsscekn |
| Contig47_gene_226 | 616 | msiiaifigliiviafpllgiiaasdiglsvllisifllngiseveynttkglintiiglimlvvslglifnpsifsfltaitiylagifli iiglvvivgnrrenkykfwmgiigiilgviyiilgtyihnsfvlgsligiwlvatgilnllsdgy |
| Contig47_gene_234 | 617 | mnanpkillyilmisalgintplsivgliisqiaeyfntsiaisglyvssfftiaicglfipvlfskynrkrtfvsiltvfaisnialiftks iyiasffrilsaifypafisialtvceeiapkgeeqdyitkillgisigsivglpittgltifnyqvamswifainlislilliifpkikg kaksyempfsslkskefllatigimmmpigasivynyqpyflqvvshvytyklsiflfiyglfsifgtwlggkliakrdkatililfqlicggv fvllylfanylipvlililifgildgmgynliqyiessvipdspelangvflslngialgiaiggflvdgfgimsififgalflllafiil yyigimkmplkys |
| Contig47_gene_235 | 618 | mningdlmnkkitvdilmfiaiiveflslpiliheivgvgllfliaihlkynkryfktigkgkynlkrtlnliinigllaslilitiisgifss qkslkgmkignhkishihksssylv |
| Contig47_gene_246 | 619 | mgpdfiisifkggaeslntsmnifftdliiiafipslyiaskivkdrpfssysssrggwnfrlyfkalaipvilyilyilgaeslilgsegtsh fsiaflavllisvplqciaeeyifrgiimqtlgswigipliaiviqaiiftlghgydalglletlvlgiaygffawktngieissalhtannf slglfimlgleasnssfqlydkiggivlyliilciimyyvgktdwfgeipedsqniglinf |
| Contig47_gene_248 | 620 | maglisgivalftswlgvsgtvigsvfssflyqflssysaekyeervggtsrkprnigseivyifpivviievifilsdmhyvfdkifdi leygifqnnlfrlmglgliaglgvypllsstniekingeivlvagiylfirgmvdindltmqvhnmffadfdfiiaiivvlalvfvifnvlrns tqeyfnkedgdydavndeftqkrifskprrkskarkidtssfhkggeykehylnsdfndkghnqspnpdsnmddyhnddlnnyqtpqedlpiye eeiiylhnpedpnnpikkrilkrvnpdshyddydetyiiddakndnf |
| Contig47_gene_250 | 621 | mkkpgilnkitilidiliiiiciligavgfavyhmvdddstkasatsfdystnnkmletymnyykdgkivtssligtksntgekiemngtvlwlgd nqndkvnieinndgkpilagfykdtpnadvfieqisletngdsyanitdfvvspkeinklkeiiskipndteyeistsiaidldsvtaqkla nalnknkppcivlknsgtvilevnranqtdfeiadnvlgdfkgtseigiriynstaqdsidiqnafnvlsiantsh |
| Contig47_gene_251 | 622 | mfienqwvnsyfkglypserflsivnkskilkeeifsplivlvtftlfillatdpvprdlqttiiaflsffigaiifprfilnqlnqlnd etntdnkesktdkskqiplfnsydvysigfclsligivlflsiasvgglpilksslrysllpaftmpvfliipgiglmashylnqyknneis rsqtrfrflvltaigigtvltlqyrtpliaillmmiiigyygkilsvweviilgallgvcaiiigiylrsinelaissntnifstlnsranftm hvlnlnyisgnfglmhgkmiasampgsdlgprmmvgkliawrtevtvtptllgqmivdfgklgvavemcllgfllgtgykivkitensfyia lygliltysivgvetgildigilayffisafiyfavilkdkgiriy |
| Contig47_gene_252 | 623 | maieevrnleviaskdtiihnlegrvkliailliiivfcvfsdrlivplvleifllivmylaelsfkdsfkriallpfggfviafqpfihpgn iiwqgpypwlfitdtglnwtvllfarlivcltaivilsstspmqevvqsfrklgmprdlamiltimvrflfifvdelrdrqsmksrnfdpfn kkipykwrvkqvgysiammflkayekgetiylsmasrcfsdnsrlyhaktiigkheyiflacvigivilvlelvvlfysgnldylgvslsl |

FIG. 9C-295

| | | |
|---|---|---|
| Contig47_gene_254 | 624 | miialyfagkwakanldekripllavlaagifaimsmnmpipfgtsghmvggalvaivfmapeaavlvftavlliqalffgdggitalganvf nmaivggcvglytykglngliigkypsiflgawlatlvaavvcalemaiagtfplsvgvasmalyhafigliegvltvivifalekyrpdllaw nre |
| Contig47_gene_256 | 625 | manlkiglagnpnvgkttlfnnltglnghvgnwpgktvagakgsykhsgneveidlpgnyalsahsieeivsrdfivdedsdvivnliidaan iernlyltvqmmelganlvvalnmnkyaqdkgytinadklsellgvpvveieansdigkeqllktieqaaanpvdsskklvynnelkehlael qavieedknlldvpsswiaikllendeiveekiegsskrnnivnetqkvkdhlkgifgegseevianaryafidglikesltkpdhlkttise kidrivtnrilgfpiflvimyamfeivftfgapfqdlideffgilgdailgslgetmlssflvngliggvggvlvflpqillfliiisfledc gylaraafvmdklmhkfvglhgkafipmlligicgvpginatrtmenekdrlitmlivpfmscsarmpvyllvgaffaaneslvifslyllg ilvavivafilrkttfkemdapfvmelpdykiptrgliimhtleksvgfikkagtiilvasiviwmlsyfpagveygsadsaigtigqviapv faplgfgewqpavallfglvakevvgtfsslfgvaeegaeiaaamhgiftpltayvfmvfvllyipcfaalgaikqetggwkypllmagltl vvayvvafivymiglglglg |
| Contig47_gene_258 | 626 | mvdrheivdkmyenkhtllfvggiataivgakilksqttkdyaakgmakvltcksdleesiqdikdnaediqtdakaaqkeaicvdvteee |
| Contig47_gene_265 | 627 | mnnqdydtgissevftvksnikllidifnlilekkaravmdlfdsltnketihnessiliigtyftgiaiakylsyngfknitivdiyphlegf idsnlgdpidvnksskgkfkeniefssdiglirsadvvidtt |
| Contig47_gene_271 | 628 | mffilfalfilylpkirhendyssiskelpyalrglstelragkslfdaldsivdsdygvlsrefsrvleeikygetsenafinlekrvnska lsrviyeilaslrigrqscpiqiniiaedvnfdmrmklkeyseklnafimiytflailapviiltmllaasvvigdivpsslfilyglffpm iivflafaikklepkl |
| Contig47_gene_275 | 629 | mfdllaacfigiaigtgtmvpgihvntagaimfassgfllsflspeflcivmvsmsiahaliefvpsmllgvpeegtassilpghrmvlegr skeairivsvggfgaivvvilmlpifavalpflqdlskpytwmiltvvsilmiyklsngrlafmwsillfvlsgilgwimlqtpissgislmc tfsglfgistilfslndssiphqnkyydfvidkdtiksifaggtagailgflpgfgpaggsiiaggvcgtsadgddtknfllansglntsdt lfsliaylignprsgiavymsyliseftlshlmiftfaslivsisliicklkgdgfsnlmggvdyrklsisvillmiylifailiyegpi lyltlalitstamgliphylgvskshlmgvlilpailiymqmfm |
| Contig47_gene_281 | 630 | mttifyfalsqtfitqlglgspqiglllyvfgllfgpfgalgaslsnvaidvyhqytfvqilpsaiisfgvsllayklwysgfksdeytkprld tiyhlclflasliicgmiysvghgnlayilispdieesilipsflnftvafimgiagiwlfkrtnlietpkkserrlnknlyrllifsllmvm tivsfifiirnsdnltiitglivvalmyaymtkpfiheigevnensiiakivrnfiiitllgffgglvsiasfdyvetsitlniylhlmpi lvisdiiiilffipgiiilkyigdnvvkpitsfseiegfikedekieaeglikvyseyvneqneigtlarsytelinhnnnyienigkiegek ertnaeldiatniqaaalpteaiktdcafivngyskpakevggdffdyyelddgnlaivigdasgkgvpaalvamitqvvikqtlinnhdpsev lfslnnqlcvnnpesmfitlwlgiyrktnkkltfsnaghnpplikengkfkyldiesgivlgimedfqyedeeiitidgelvtytdgitdannn dgemygedrlleffnkfksdkdpilpllkdindftkdteqfddmtllylkvnd |
| Contig47_gene_284 | 631 | mskriewidlvralailtvlyihatdgiyiissdlipywtpfsrvfqfislfigrigvpfflmitgylllldrtydervkkfwnksckglvi vtiiwsliyavsiqlvayssiqvntieagnlffshmwympmiigmylsmpfvanalknfdprtinqativfsclafllpfisivcemglqnv niqyclgfsggvvgiyiilgwlvkkglfkkyssnslrllaivsfiicvlfqwyafsidfsflwyefpfiltgsfalfelcssrrekvrgfrgv eflakysfavflihnlfriiiilpmvvylpytepvkailwillitsyaaviiyripkfgkfilymr |

FIG. 9C-296

| | | |
|---|---|---|
| Contig47_gene_286 | 632 | mnylnqnyatvfmgndfllliasllimififgygsvitkdvirggkklpkiyikectiygikcvivaliysavqtlvmvdlshrflfpefele haltditgtlqmftannpilligeyvvisiiltyifvffmeislarladggkllesfnliaikrcidtigwkkytidytkllaitiltylqyg fqflgffdyitdlifgllvfiilqfigigiqiykiykikkysnldrptkksv |
| Contig47_gene_287 | 633 | mlleliienlletiasiivflipiglgikyimnkikkheskftnnrllnpaeympkeevetlkqvsylivlflififfiysfwpmanmkffsfl eivlmvyialnidysnwknkvlfflvpygsiawflfeeltnslfdifhmillyfmkvyyekfreytetnglgitillftiifisfiltmi vegvspidsiamvsnaftsngyavlgssfggklnsillvwsgyilswgvtatmtvallskhfnkrikenektneaqyaelkemiernneeike ilkennlekkteeelekkiiep |
| Contig47_gene_294 | 634 | mleslrpfltkilepiasrlninpnivtiispflaiisayffatgnliggalfillsgfldvvdgavaryhnrsspfgafldstmdrfadaii figiifggycnwfvgvlaihsaitvsyvkaraesgqvecntgiaeravrliilmvgaviafifnsdiiftyfiylivvlsyftvggrvyhvwk elnkkkipqrrl |
| Contig47_gene_298 | 635 | msfcpncgverkegshfchhcgydyreanssgmgssssdsqvnqnpsfnsqvnqsstynvptkqnphnfakitgyilsflipvfaivigiyl ilskneevhkhgiiiigisivvqilsmifmmg |
| Contig47_gene_300 | 636 | mitvivleipmavdgswgalldiklefivyavsfivcfnfwnynnnvfsmvnkidhkviwsigiamffslslipyltftfvalnpdaflpsflyg ldfiivailtiftinalknsdkanialqialadnqpyvttivfvlfgmivgyfiyplaiviaclfsiitlwlisyykkhg |
| Contig47_gene_301 | 637 | mtnrfetffdaliiaiiitvlvlklsqpaaptvpaflalnarfityaicylalfiiwydnhnlfqvveeinntvlliyaiqmfaisllpyfat wvalnvnsiaaetmfgidflailililyvlsiyavyradpyncgisknnfrkiycyipiiiivligifnklyslysrnichsdctdllaflfkts kt |
| Contig47_gene_302 | 638 | mrdcsncnrescllqkvagiimvfgslyyilaelisagffndslintylfhtiselgvpvansplsflmnsafiligitlllgyfakfrdfii kykllisilavitalgvliivgfihagnpltdgyhslgavmailgggnvmlilvsramaefesyqkitfilgliigfivfwimffnleslympvfe rlsvytliiwnfmtgfylykns |
| Contig47_gene_307 | 639 | mkcpvcgcenpdgykfchdcgnplimpdydemndypsfdskklliligyiiailfgwqtfilsaifgsygfigfiglffpgfmlnskdsnirk hayiqlaimivgilatflvlfr |
| Contig47_gene_310 | 640 | micpecgaenqdsakfckqcgtslnpvatmkktnsdesrpiksgifnennsspssfeakgsgqdnknliiicltvilicavliaggliflsngs nngndssdvgnsislpdnsvnqtddsqnqtdtepapkkssvsdmkilsgsfttgsslsdktwcsvyvgekyagedvkisvlysrdgsdlnqgk ivpknvgsdqtvsvpsadafkyypdhalvtiydsngnvldtqevimsaksgtqtf |
| Contig47_gene_316 | 641 | mnyqeelsdfwkgckrvlvakkpdreeffdfskvtaigialigvfvilfgqllgl |
| Contig47_gene_328 | 642 | mgkrgymgnlyetvrggtpravgivpfilislfmpsgfnnlvlvmglcaliddiigrktianlpieigqlargigmlcviglgypimgvssil vvlliqpmniadmqpgtaaattiimsfftllavvimqvgpvleihpyyyplllvtclaycpldfagkimmgevgnhtfaislgicfyalggf igtlilfivttgliaylrrynlsrflinklhipnptfgdlfmdvltgggigdlfrkillksnqydvdneililagfrrllynpyspnlekvvq kdsrtkradlrrfy |

FIG. 9C-297

| | | |
|---|---|---|
| Contig47_gene_331 | 643 | mikqtlglnvedkkyylkliieavligifsgfivslyriglldhsesilsyilkyiggdltlivlwfvilaimglitallmkwqpdslgsgipq vmgevkgyfdvtwwktliakfiggtltalggislslgregpsvqlgamaakgvskylpnsktdekrllvcgsgaglaatfsaplagfiftleein kgfdrsivlvglvsavvavlvsnvffggspifpftslnlpleyfwllivlgiailgiynvgmikaaemwdklsflpleikfiivflvtgi vglflpevlgggysmmhlielslpplsvlivlligkyllifcfgssapggifypvlvigayigaifsaivipifglnpliaykfimismaam fassvrtpitavvliaemtgvtnsivamivvvilayiiptildndpiyetllmrllkknkgidfdktksvleeyvvpmdcaligtkiwelpip ksamvvsvvrsgntlipdenlelkyadelfiimngntypednnkiesliynnwkee |
| Contig47_gene_338 | 644 | mkealminwgyvvlfillgaisykrksldmlgalimifmgitiifsagvswfilivlfffilsimatrfskpykkeigqyektrtaknvisngl vaflmaafgsyylplaggfigavatatadtlaseigvlqeprlitsfkkvpagtdgaisilgtsaalvgagiigiasfllgimpdpliaikis visgtvgcfidsilgavlerrnfinnehvnllatisgailigilisvm |
| Contig47_gene_365 | 645 | mkhrlnldnkdpnyillkeifkimdsrksksilasygfknlnrtiftfkiifismffgidipfilnelkskkelrkyfniseviltadqvykif seinseklikclnrilnsrnmvkrrgkktfivdatpvdvdinfhrnkktkehlekinlkwsysskgyyigfkatvvldydsmnpvcilvhsg apndaklfeeilenlqkrriirkgdtlifdkgyysyknyqigiskykiipfifpkekfsrtlrlddiltyllavfnktkrimkekrlynslkme lmkkidswekfkpirgkiedfkllkglnmreihkytpksvektvlnvflgaliisgfysktaigqlsen |
| Contig47_gene_366 | 646 | mlwtdfivlaivyiyvvaifilsekvlksrpevsrkflhimvgnmifampffsdpwimlfitlpvtvalfflteyspiqiensvtesghalg llfyaliwsillfvypimldpnylwivamaivplvygdgfaalvggkwgtikyhvfggektvvgslamlsvtavlsvfvwvfyssigytlpel nlwyillisavatlcealsyggvdnltvpavtsvlyyivatvl |
| Contig47_gene_371 | 647 | mnikelfieslkdnkkliiglyaffiivfiaawiitgpkmqaiasnvtamngpggaqssaielfihnelggiitylasvffgiaaivllgyna lnlgsiglfnhfmpnggilylylylyliphgifeitatvlqsaagillfiwrfikafrskdtngasdafemtkktliqsivlmviatilllia apieayfstafsefimgflglr |
| Contig47_gene_385 | 648 | mkylflifggldidiyllltilfgilnmvpmffeekksrpitrlldtisgfwiwmslfyifvililyigvyidwpfyiliviviviviplitvy syfhahkiihertiqmdninediniahlsdvhfgstrhdkiirdlsdklkelsdycdlaiisgdivdgssaieeddflplkdvnmpivftpg nhdsyldiedvfgacrnagiivlddegmefgnlnifgmtfifgmtrkfeefevvstgvlgdfvkedkvniiifhvpknwedfsklgfdiqlsg hthggqfhpltwicdliwynrglfkaniggkdrylhvttgvgsmdypfrwgtdseivlklrknd |
| Contig47_gene_388 | 649 | mlnlilililialiiifsiilyngliriltvekekaearyklkitllkipiftkdssedkateseeekeedgeeeeskdkglmekyneikpi lkeliskkelkkylkdilksidikkleghliilglsdsfttvkiaswiwsigaivnskkpvsltvdprfteiiltdfeggllelkinllkiifys lilvskkdirelikviyaykkakdkeneekensneelykkekdteikenskeelykkekdteikenskeeldkkekdteikenskeeldkkee ket |
| Contig47_gene_393 | 650 | mddetnnnqwnsstsfilvmvgsiialagiwrfsyliyengggsflipyilaivimvipllvefgvgfkykaslprifyniksefeivawfi lflifivlicytcimswdliyivlslfkgwgnmpsvfftttlhstsnpygltylvvpigigliliwaliyfisrreinrgislvtkfslalt fviiilsvfalqlpgsrtglmalfnpnweylldyniwltafgqlifsygiaystyssylpedsklidsawvivlislifeilmsvlifa llghmalgknmpitslvsdsfslifvvfpnvfnvmgswatiigplffmvifigglgalfalieplanaicekfiwtkdraiktlvlaglfasf ifatgmgeyflrivdgfitqfaiilvvliveilvfgwlfdlddirnvlnnnsriklgkywvylikfaipliliviwilgvynliitgdrqsllv qsilasiivivplaltvapfngeyslgsitggynyfrdsgddeeaksnskpdlksrftsrftskdndvdngtegyeektyvektiddyegydg vvaitdeeensslksrfswdkfkksksngknvlnnvdlsakefdppsdddydyetyklv |

FIG. 9C-298

| | | |
|---|---|---|
| Contig47_gene_394 | 651 | mansnqsewdsniafilamigsavglgniwrfpnvlyshggsfmipyivslfllgisfvlveyavgyrfksslikvlysvksklepvawfia livflittyyicvvgwdliyvvlsftkawgsnpdlffssivlqstdsiegllhivpmvfisvlawawyilqkdindgigkvskllplll iivtivlfsltlpgasigytgiftpdwsaltdlnvwlaafgqivfslsigmsialtyasylpegskltdnalivafsnsgfeifnsigifsi lgfmtlntgipfdqlvtegtglafvvfpkvfnimgpwatilgplfflcilfagvtsvmallevvcysisekfnfsrrksativcligfvsvi fttsagsmilgifdaflnniallfavllecilfgwiynfdnlietlnnnsnikvgkvwknvikfilpicic |
| Contig47_gene_395 | 652 | mnldsnvktglivaisiflfvlslfitsaptgvdnsarfgiltllppliaialafitketilslfvgvfvgefmvsvsdiniissavnafla mggqiiscmadpwnagivlqclliggvlqlitkmggakaladalakradtprkaqlitefglcvfddyansllvgpimrpvmdklvsrek lafvvdataapvagialistwiglelsiltggfesigmnvsgfgiflqtipfrfynliliifivisavtlyefgpmkeakrararkadepvk sleatsfddvkpvegiklsvwnalipiavlligaliafywsgyttilggedqalihlmktspisfngifealsasdasvalfqaallasivai vmavlqkiltieeaisewiggmktivitgvilllawslggvigdigtadylvgilkdtipvfilptlifilgalisfatgtsygtmsilmplt iplawavnpdmgfvivctsgvltgaifgdhcspisdttilssmgtscdhidhvrtqiyyaifvasisiifgyipagfgipwyisipvaivvdv sjglrr |
| Contig47_gene_408 | 653 | mekqqvktilksvviaililivfglraqsvdiggvpneikshyvdenglpyfsemdsyfnyrmtenymdhgyfgdtkvngtgwdmhsyfpsg ravgdyqpmiayvtsflygiinmfqemsllevafwtgaivsslaviptyiftrritndygaiaasliivlgpnyishtfagffdtdmfnitlp lffilffvealktdkisyriifsllavasialyslswtgymfyvavmvlvmivffvlcfyfnieilepfknygnklewlinqkelfatlivlv vgliglllavggliegitgltggftlqagaadvwpnvlsvaemqipnlvtgglvgsflantggvngvggivclfgvlivlytfvqrlfr lnsvkvkgdtakphkskrkatsvrteqkrfsvslkdigsfgstdeinkskrhtvlyslffwivssaiavtggtrfiqvlvvpmgicagifv gyavdyvknnvdndkvllliaviasililalpitqiayglanamtiglvvlvlllaisaiviyakksikdsdvsikkalvvvlitlavsptvc gafqttaatvpgssdpmwfamdyvkenstndtviiswwdfgylfqvasdhptsfdggsqtgdraywvgksltsdyaqskgilqmlattgsna smllseytgsnvtavhaldetlgksrseaqkiltskynlltndqakavvkqshpsnpnnvsfvlssdmigkagwwsyfgswnfdtlnstnyqyy mandyvpikqntqgnitilnesgiiiyqavvnrgkngtnettaqmetiwdmnrskidlngteynplkasnliciensyltvnktlnkdgnytly llgsgddytailmdnnlkdsvftrlflllggiggdtfelsnmqdgvsvwtlrdgssnsddagsq |
| Contig47_gene_420 | 654 | miiigglknmnetikenswwplivvalasfivaldatfmnvsisqvvvdlntdvstiqsimsfytllitaafmllsakiqdivdkklfligta lygvgtftasisssagmlfvgwaaiegvagalmmpatvsiisgtysgekrtvalaivgvmgavaaavglfggvmttflswrygfaveliivf vilifrnsiphfeptesrsdldisgaiisfiglvllvlgiislskdfttsigilivvglialvafayfeirrkrngkvplldmelfkdrnlrvg tillsylamgglfavslflqsvlqlnafntgvttlpltlglliifavlapsltekishkkinaigcimaiigclmisyqfridtltwtllp gllvlgaglgfimalctdislsnipaesqnnasgvnstgtslgesmgtavigililgvmggistavdtyapdhsgdeqfglevanyfqkvat iddilkqdstlvdvaniiiqntmafvmqvtalimgvvflllttrlkdnkikq |
| Contig47_gene_421 | 655 | mepnkvsgilsiilgllifiifplvssglvsimigvslfglgiasiltefsalniiigilailgfgllfinidalsflligfqfyiigilmilig vagifagegvskiasililigvialglggfsltqpifaavligvalitqqvrlyvapkn |
| Contig47_gene_422 | 656 | mgvnmeimeiikdsflfpsknlgtfsiyvvlsvlvatffggifsyllgfigseyiligglivfamligwvmsgyeisiilksgidlddevpe fkwwdnfitgflnfivaivyfilpafivgvvgylinindklmavaqeisslypniffltsspdiafealsqaiielivplaliiivalivfvif lflqsmaearlantgslsealnifeaakdikrigvrkviilvilvfvliligvigmvtsvifnyvptlsllsilispylvffaqratgllysdia |

FIG. 9C-299

| | | |
|---|---|---|
| Contig47_gene_424 | 657 | meiikgkeipkkslkrslivfignmigiylisilglgveisqtgdifllvlflgivnailwpiltriampflvltfgigsliingliiqllap sfgieikgaamilaplgmaavttvlsslitinddssyyrslvndakknaknevkdypgviiveidglaynvlceavekgdmptlkkmiesedy nlrmwetdlssqtgasqagilhgnnegivafrwieksngnqmmqcsgisnvpelekrisdgnllvengasrsnlfsgdtdnviftfskimdf gklynkawysvfsnpsnfarivslfladivreiwsqithsikniprinrgiayiptraatnvfmreintstligdmmvgdvdvaystylgyd eiahhsgvrdsdawialrqmdqqikhltdankysprdyqfviqsdhgqtngatftqryggtfedfvkslipedmtmfakmtsnddhfvgdytp farkdkiekekeaakelsdsevivlasgnlamiyltqwtnrlsnysfpelipglinneyvgfiilvksqehgdlaigkngtyyldrdei dgenpllgfgdnivkhklkrtssfehtpdilvnsfydeeadevcafeelvgshgaggdqskpfilypsswnvsddeiigaeniykllkenlae lkk |
| Contig47_gene_425 | 658 | meifkvvceliipilifgvlfavgkfihvrlnsksrilnpgeyfpdeeletlkqvyylvnmliffafilyimivqanevfaiavlqilvsvy valtldysylknkilffllvpfeaiiflvfndflmiwpiylmhilvyayfikvyfdkfrkytetnglgitiilllfaivfsfiitlfvegvep lnsavmvsnaftsngyailgnsgigkltslvlvwsgyiisgvgtatltaaimmrhngkrekelnkrldelesliknsnnke |
| Contig47_gene_428 | 659 | mdllfyvvlliggcfagfmagllgiggivitpiqvylltsigcdpktsltvtfatglavicvtminstrkhkqnnlivkqhlkpmmvfgfv gailgavisqyidvevlkilfgvicivstvflvliksptsldniktdaglfysiafacglasgligpaggafiipifvaylrypintigtts alsiattlagvicyivlgwvqglpdfslgyvnllqfvfltitsiivsgyaanlskkinptklkalqvivisyiglqmmgvfdiilsii |
| Contig47_gene_431 | 660 | mnniayllailfetsatsllkvaegftkplptiasiilyilsfyslsncllktapigvayaiwsalgivltivgliafkgtpdwaailglil iiigvgvlnlfskmslh |
| Contig47_gene_433 | 661 | mkkflsvalkfqwktivfifaliiiqtfvqmeilidlfgaaltgvkeqnvdllfksglymlmytvismiavyvisflttrvasksaytvrekif hilmnlpreeidkfkisglvtrstrgmsseqgfivmileqlmlipvtfvaivyeialidgtyalffigfigvlsaiiifrmkqiveiffrakk tygklnllfslskindiagripfnkqeyevefekacensydknviyiksqcylgpilmwglyvivlvtlamvnsgytigfetdsvidsfiilvy vayfittlanipalidrwprayatsvrleevlniedkiiksntndnlkeieiveediageakgiwderkgisekftallkedkakvrismill tistlcmvyapkvagktvdllasnwnstndpaiyislalllvlysvgylfklppkrimgatgekvaydlrvklfdkldavgsdfigenskglv lsrlnndvmnirefvsskfteiyaqilfivfvivlivmtdfrislylylvilpvyavcfyvcdvksknyydghqmlgrlmsyferglsnrdsf hekgfkkmnqtvidyyvksknvtnfmvpvttlltniskitvyiagiyflagneigtlaviimyggqlltdpikklsssmatietsfssikri faiidykndk |
| Contig47_gene_438 | 662 | mdllfyvvlliggcfagfmagllgiggivitpiqvylltsigcdpktsltvtfatglavicvtminstrkhkqnnlivkqhlkpmmvfgfv gailgavisqyidvevlkilfgvicivstvflvliksptsldniktdaglfysiafacglasgligpaggafiipifvaylrypintigtts alsiattlagvicyivlgwvqglpdfslgyvnllqfvfltitsiivsgyaanlskkinptklkalqvivisyiglqmmgvfdiilsii |
| Contig49_gene_6 | 663 | mnlykdifylagfichqkpersfhishcqlpfcarccgiiisviasfilaqfvafpmnalafllfvpmivdglvqkytdyestnfrrfitgfl fgfayvvfymfglnai |
| Contig49_gene_9 | 664 | mkilktwiekldiilsililvrflrlllllfkesykyvkkffkatsfdkvvalfivivvgstfaleyfdpaipnlyslwfvfqtittvgfgdvipespvgql lhislinivilvrflrlllllfkesykyvkkffkatsfdkvvalfivivvgstfaleyfdpaipnlyslwfvfqtittvgfgdvipespvgql ialgllmvgvlmfsiftasfaylfnekvfreenedfhekintvrenlaenkerveeirqstlstseeiaevkekInkseeniknleeridyli dmiekke |

FIG. 9C-300

| | | |
|---|---|---|
| Contig49_gene_22 | 665 | msyqennasdkslqdkdmkakgrqdrivktsiigivvnlilvafkatigilvnsiaitldavvnltdalssiitiiigaklagrapdkehpygy grieyfasviiaaivlwagitalmeswpkifnpdvtsyttvslvivavavkfilgryvknvgeeinsqalvasgsdaffdailsfstliaa lvsiffhislegilgvliisivilkasidmlketvdsmigervdsklsrdikeaicefpqvygayglshnygpdsmegsvhievddsltalei hnltrlismkifnefsiiltvgiyarnddfkdirndlyeitskydevieihgflaypeeklitfdiivdfdadreevkdkildeikslhpdft ycmiddydlsd |
| Contig49_gene_28 | 666 | mnreerdrigtrasavaiignilltvlnisvglmsgsyaliisegahtisdiatsviayvgfkigsrpadkehplghgraeaisglilvvflsi vaieviggafhklffggalevpdpiavvmafvgilvnlfmssyiiirlgkkarspaivadgkhqrvdifaslaifigimvsqygypmldpiigi figaliartavivaidnlnnimgklpsdelikeirdvansvtdvcsahdikvnyfgsyatvalhvelppdmslreahkithrvqdkilenvdm vqavhvhpcpegvqdhsqlldeds |
| Contig49_gene_32 | 667 | mketlikefkdlkeetgqasvelilligsilvitiicgtyvfnvnskingqfnqtmtkarlflnkv |
| Contig49_gene_33 | 668 | msaneieifesgngmnrlpretvfeqikrnfvqlkdetsgqgaaeyillfggvivialaglliyrsyfsnntsglnatqdinsirdnmsnvl |
| Contig49_gene_34 | 669 | msdsldlftgvllttaiglvlliygsiiyrlidlvlilgvlvtlfglykllpaffmrllssrksssrnklskanvsqdsllkagieeinnfldge dnkensksvlraressldapnqmtfeeymsksktdyatnyspkevkpifkdrdvdeskqvlrtkpvkeeksfklpsfkrnsskpksrnfa frkdkdterspdklyftpnyenpmmvspkpkkksenklrlsdspkrskeiisealasvgttetvydnnasddsysympkemddelivpideidl dgpqeapiytlsqsentlynnviyddvdsdfyitpihaesnednspdeegdyegqdlyevepedtsygndlyietepednyygndlyiete pednyyddediyesyeeqsyedddgyitveasdddipirkeistpqslprptsiastnpiskkevgsnlsrphkkvstlprpsvssnlq rphkkaestdavsvkdeskaaeasiakpkpiakpkpvakpkpkeapksdeliskeeldqiiqdpkdntiqidpnnpeslpipklnsyvvcek giltsqeafeevashssqeilleaptikdmgerflssiadiktriivqefdladisyvllsslikkgveiktlpmvnsfnligddshaliis nsmdeddfeygavytdkpsidnikelfessswsiandldigninese |
| Contig49_gene_39 | 670 | mdttvktvsihlvaavvaaiistaftlgwfgfknnvfafvigvvilyfigqyckkafgeeisgfstwlwdgilpfgffwfilwtiltnyl |
| Contig49_gene_41 | 671 | mssvaglskyirtlpkakstflmiivlsfiigavlflvkpmslgsglenffyggafgfvvyglpaiitgatdqkwvstlkginlkmkhsmfla lvsmtmagvisiigtiignilhfdlfinsilfgiviafafnilviwsvtrirliksvlfdnagealdtlvgvcsfrkpdgdikalfispcvhpgplqd iggsnmptilanrfdsfamvahgpsthdfnpvssdeivkiessvrtalenmeysskasrfvryshkanigtqffnngcvmlstfapsgsddi efavglatmiesqkeleidnpilvdchnsfnaekggvlpgnpelfqlldtikliekkdleheikvgcystdligfgkhegigdsgiktmviev dgrtayvlfdsnnmelgyretifnavedeleideievmttdthsvntlsagynpvgtvekekieyvresiieaiddletveagtrterienl ktfgpnnstelistissivsvskiaaplifimaiiifviwiylf |
| Contig49_gene_75 | 672 | mkagvlvftgslvaidpsfypimllqlviqaimilyldevvskwgfgsgvgliaagvaetiivgtfnflpasaasttasgilpafiqsiigg apnfqilipliativvfliavygesmrieipishgrvkghgrirgavgkyplkfiyasnmpviltsallvnvsliaslfqklqfpifgevsqq raisglalwlttpnsisvlftnplrvlfyaivflgccvlfswlwveisgslsakevakqlynsgiqipgfrsskrqlytimkkyipaltilgg lfvgilafiadltgalggtgvlltvgivyklyeeiaqeqlmemhpmlrkflgnd |

FIG. 9C-301

| | | |
|---|---|---|
| Contig49_gene_77 | 673 | mayqgsfllgiswlqpvfdamnavlnplvqldptpnnpvltvfvisalisllvtaqkllvdqkmnemqanskalqkelreaqksgdakqia kvqakqtdmmqdqsevmkmsfrpmivtmvpillifdwmwqsairslivffppavyyctltpifhslgqmlyggnittipfgvgwlwwyfictf gmsqiirkfmgfkngf |
| Contig49_gene_83 | 674 | mafllitclflffgsgkviyqtgffgivvtddswhyglytffrvlgcfpilgflalttpiakifhcletlkvpkivieigllmyntififl neidvmqkaqktrlgynsywnslqclgslvsniflrslekset1qnsldsrgydgelpvyippkee |
| Contig49_gene_84 | 675 | merttliilavicaiifiaplvmysglgeddgyfggaddaageaieesgfkpwfssiweppsgeiesllfalqaaigailigyffgywrgqk ee |
| Contig49_gene_85 | 676 | mhimegylpltwciiwfvvsfivvaygiygikgivdetpdskallavsgafmfiilssiklpsvtgscshpcgnglgaalfgpavtavlativl lfqaillahggllttlganifsmgiigpfvawlvykacikanisstiaiffaaflgdlltyvatsfqlafapsfgsaltkflvifavtqvp laigegiltviiwdrlkaykpklldklgvlapnea |
| Contig49_gene_101 | 677 | msvfdyichrrpersffykgrqfpvcarctgfyisgiasiilfkyfplpntlttlaigilllipcaidgtsqlfemresnnvlrlitgllggv glimiyevvlnfvflnfiy |
| Contig49_gene_133 | 678 | mskfcpkcgcenldeasfclecgaslpsieevkersshgagtshqstfssnlneengfnqetssfsqsnsnneasnsskfknvineanpann dnqdyaicclvifvllliaflcnf |
| Contig49_gene_153 | 679 | mipyyilpsplnvfnaawtlitngklfmhtstlikvfsgiilasvvaiplgiilgwyetldrlsslliisilrppiswipfsilwfgigls savfvifigcvfsvlvytidgvkrtdnvlieeaqtlgannwdillkivlpstlpylvsglkvgvsialmctvsaemiassrglymiltasql fgpgtvvvgmivigligilfdygfrkagerifw |
| Contig49_gene_169 | 680 | msslisiptlplivialicgilsfistrlvmpwligkleqaeiigkdihkssrpivaemqqigiifgfiigifagiilfpvltfqlvvllvv llvgiigmvddllivlsskeklflllflagiplwwappnvgllymimipiavsitsnltnmlaginglesglvismtsltisciilgkydvai ismtlgtllaflyynkypakvfpgdtgtliigatiaaiafigrvkliafivllpniidaalkfysagvmerqqhnptqlnedgklvrpeqgf kslirlvlrkpvdektavmmiwgigilfsgilgliivallmpgvthdgtfaqfihlkdyfyylg |
| Contig49_gene_173 | 681 | mdskglinielifctiilvmilivnfpilehsidsandmdensqgrflinsistsidqvnsnnegfskkiklpqsvdgnyytilvssneiile fnnkkgkakiqpinlvdsknrtlskaqlyngqsyiikktltnnneshiyngssiilimqveg |
| Contig49_gene_191 | 682 | mnkyikkwtesslilkiliiggliigsvlglliigsvlglvpqykliglpgelfvtalkaiapilvfilvasalsraseqigsrfktvivlylfstflsamva vtgsylfpvqmhltdasdvaapglgevissmlikifanplqslsgqdylgilfwaiviglclkkiasdstldvfsdladatslavrgliiqfa pigimglvfsavsesglsifiqyqqlvllvgciatvafvtdpiiaafalrrnpyplvltclkesgitaftrssaanipvnmrlcerlgldk dfysislpgstinmegaavtitvmtlavchtlgisvdlpttivlciistlaacgssgvaggsllllipmacslfgipsdismqaiavgfligv vqdscetalnssqdalfsataeyhdrvkrgedmnflgefakdkakq |
| Contig49_gene_201 | 683 | mikkvtnvideitdflfglkmtiisgiflliavifmifgidtpiylnpawgtviisgipmlllamtrlirekwvssalliaiamvasliigei faagevawimalgalledwtverakkglrnlinltpqtgrrivqdseevisvdeirigdvlrilpgesvpvdgeiikgsssldqsimtgeslp idkevgdevfcgtmnmygaidikatslgensslqklidlvkaadekqaptqriadkwatwlvpvalaiaivawlvtgniergvtvlvvfcpca lilatptaimaaiggatkygvliksgealetlgalntlvfdktgtltygnlavsdiislkddldemdvlrivasceklsehplakaivnyane akvdieepedfkmypgkgvycknsyghicagnskflnennidfnigskdcldvdsilnhlkqegkasiivalngeiialiglsdvmredskam ieslhdlgtetvlltgdntetanyfasrlgigkvygnlipqekldwierfkdegkkvcmigdvncapalktadvsvamgsvgsdvaieaadi allgddigkipylkklsnstlftikaniiismtinavaivcsvlglinpvtgaivhnagsclvvlnaallydrkfddsikridtenvehshyh |

FIG. 9C-302

| | | fhndgehshshegirlideiktdngikhmhihkhalnrqsceayhn |
|---|---|---|
| Contig49_gene_205 | 684 | mdesankmnkfdvlgsmnlrtktllaiglsafilivvlvsffidptsittdwsimnqppslehlfgtdwmgrdmftrtikglglsvqigffa silssiiavalaflssfnkyldsfvswlidvflsiphillililisialgggafgvlvgvafthwtslarvlraeikrkiktsefvtiserlgks kfwiarkqilplvisqvivgtilifphaimheasvtflfglsphepaigiilsesmkylatgnwwlalfpglallilvllfdiagenikkml dpasand |
| Contig49_gene_206 | 685 | mqflsfselfggtvlveqvfmypgigqaavsaglrsdvpllgivifsaifvycgnliadilynfvdpriregeeng |
| Contig49_gene_207 | 686 | mspinpvnayisnmvvspekiakleaywgwvnqpiteklinwlgniitgdfgtsliyrtpvlqviaekftaslilmltswvisgilgfalgvla gfkrdtwidrvvkvycyvlqsaptfwiallvvmvfsiylgwfpvsggvpigalsqdvsffdwlkhlilpaftlsilgvasialytrdklievm ttriyfllipkakrgirmdld |
| Contig49_gene_217 | 687 | mknirqtlstigkmlsplkksipsifliflilidvycnltlpsytadivdvgiqntdfnyiisvgtmmmtmvligvlatialsyfsskvsaa ygrdlreisyekilkfsnfelnkisrsslitrntndvyqiqlfgliftiifapiligsiikamelgtdllwivvtfasvaillgiifir tvpyfkvmqelidkingtsreilmgmpvikafirqdyeeerfektneefkevnlhvfktlflmipamtmilnvmivlilyfgaydaingkilt gtiiafiqystqivisflmlggftimiprilvsgrrvgevlnteisisdgpidkidenptiefknvgysypgseketlkdisfklekgkttai iggtgsgkstilnlipriqdvtegqilvndknikeyklstlrerisytpqkailfggtvrsnmqvgkedatdeeiekalniaqvdfiesldde vtqgasnfsggqkqrlsiarsimdkrdfylfddcfsaldmnteakvkenlkdlkesssiilisqristimdadeivldegkiidkgghdyly kncdiykeivssqiersedliydneetasftidsssikkaagk |
| Contig49_gene_218 | 688 | maprprlppekptnvkeaiknifglmgyklklsitvicgilstvfsvispllliglattaifdggingsnmnleyiinllitvvilyiisavf sylqsyflleittdisynlrkeliekithlsmgemdkntrgdilsritndvdslqtglnqtfnqllsgvitivgvtimmlsiniwltlativl ipiaflliitfvtkhsqdyytkqltyrgslngieesftghelirsynqeeqsmetfrednenwyeqewkskfyssalsapimnfisnfqvviia vlgavfvlqnaiavgdilafiqysknftttpiqqitrvmnmvqtamaaserifgfleieneenpskekiekindsitfenvtfgytkdepvikn ltftakkgekiaivgetgagkttivkllmrfydvddgeikidgvninsydkhsvrslvgmvlqdtwlfndtiynnikygkldateeeisask eahadhfirqipegyqselnedvdnishggkqlltiartiisnkqlllideatssvdtrtekiiqkamdklmekrtsfviahristvrdadki iviedgriieggsheelleqkgyyyntlntqrreniv |
| Contig49_gene_225 | 689 | mifvinlvplslsvvtfslslfsggftilfgadlafivlsfgqheftphpfgpialalivtalaslkvmegsgvdisrlknivyvfliaitvfg gamhrsflllwfiglfigytiisksfrqksiltirrilmfflaalvafgllelvsrilsmevfsplirisrlaqnslaslklvigntqlighd passywsdstgfadgyislpmqfilmfglpfplffgllvtkkdtidymlpgifgyaydfgyltfvilllvlftiiigllvlreyrlkreknn kkylgkevlligsltgfiaqaiiglflfnrtingmallltflflgslvlahvvtirrdsnevlsqqi |

FIG. 9C-303

| | | |
|---|---|---|
| Contig49_gene_227 | 690 | meekkiestdvevneskdlnldstvenneidkteeldasseideneelgtssevretividtasevveadvvsetidssesvkdeeedsnpld veyveedgkrrikpmldyeslsntseievppllidqvigheesvetikkaakqrrnvlligdpgvgksmlakgmaellppevledvlvypnge dsnyplirtvpaggkkivkankanaksgdekkmmitmfataaifvlgilyqrifeailaallvifismqikpkannmspkllvnngdkrfap fmdatgahagallgdvrhdpyqsgglgtpahervesgmihkahkgvlyideigtmsmktqqellsamqekkyaitgqsenssgamvrsqavpc dfvlvasgniqvlegmhiamrsrirgygygvfmkdymedteenrkklvqfvaqevkndgriphfatdaldeiileakrragrknaltlrlel gglvrssgdvaieegadlvtaehvtakrfartleqqivdrsiiqrkeysvfhssggkigmvnglavmgdrsgivmpiaaemapansknegki ivtgklgeialdsvqnvsaiikkytqvdisnhdihvqflqsydgvegdsasvsitaavisavegipidqsialtgslsvrgdvmpiggataki eaaeagikkvllpksnmedvmlekkyedmieivpietiedvleniingskkeklinknerngwsshkqgly |
| Contig49_gene_231 | 691 | mssgltiglsliifgnienlilasgvvkaanplklaifslicvscwllgtvctqglqnygiyiefiggfaifvlglqsmieaarg |
| Contig49_gene_232 | 692 | msfaeslkeykpflgllifgnienlvlaaqgviegadpflvagasvcfviiwqfigvfgtksamkysrhiefiggfaifvlglgqsmlpliyql lg |
| Contig49_gene_242 | 693 | myltkfcpkcgeenedvaqfcsnyghdfkdvnqrmkeskrenssfplsgtkillcivllivlliiaaflftgnnadkpqnitmikentygftfv nrgvlfynyhldevlpicrmisramtlrqdstmqmthwlrsimiti |
| Contig49_gene_243 | 694 | mksiednasektkqlqkkqkkiddiseadideqietlekenkklkryqrildalqekmeidsgrvmgltdgifsivmtllifgitlpsteil tdaglssfissilpnigvtlvsfillasfwiyhhefiklkclnlvylwlsmfylatvcfipfttligtypefrlstnifginillviiffll mlnyaskrgfldeeviekdkyvhhtlyiilglaviinlldfsvnenfiylflvpliistirdvrfklknte |
| Contig49_gene_247 | 695 | mqekidlvslpkksfwklsipiiafcifdaiygivdmlwvsrisveafyaigvsipitslifsfgdsigqgtnsmmsrfigtgdyesayntli hgilianiwlilvlclifaggilfkvddadsyilifdymvpmiifayvfilnnlfsetfgaegnshtptiligsnilnildpififdlnl gikgaayasvlsslitfsvlmflythgrtkiplsrkyfkfrsyilveifkvtfpnfiddaiwsftmsfinviligtmgeigpilysvsnkirs llnaptkgygrglmsvtghlfgaeqfdklkemykyvlkiavctslvimivffvrnwafglfsitgmdneifwiavggliimmtilpfstissk mldgfgkslyslllittikvaieialislltqylkdgssvligiilseiissivyykflgylfdhfdkkyefkytvkaftikrkdkrekrreri rqnieekklrkeekkeefrqnieekklrkeekkeefrqnieekkmrkeekkeefrqgleerkekrkeid |
| Contig55_gene_5 | 696 | minrlrkdfgriiklliflilevilffaitqtfggiilpdlktafaliialsilnallwptitylslrfivltlgftflidgvllyiislfi pgvsingialfsipllligllssmlsilniddytyyryilekemkvihrnipkkegflfleidglsyriikealdngdmptlkswidkgshr liswetdlssqtsssqagilhgnnnipafrwvekdhenriissngrtdskliekrisngkglslngasrsnlfsgdakdhlltfsrfsdse sinsnswfylystpyviarilvlfifdmimellsrvrhlfkniqprlkwrglkyfvaragtnvvlreattftligdvfagehnviyatmgyd eiahhsgiedfdsfyslrqidkqfkhienainnsnrdykiivlsdhgqsngpsfkqkfdislndllseflpenitvhsilhsnddhfskefsi nhlgsenlekldkrventkekldikidntkekldhridntkekldhridntkekidttkekldhridntkeridsnldytkekintsfdgelintwdklikfknkssnkafldklrkkrtlinndepiidrinnvsedlsedlevnielskeitsd kaaqtivlssqnlgliyftdwsnrmsyeqiedafpglinqlashdgigfvmvksdliygtlvfsndnlfyleseeyvgenfldkfgkntvqklk rtdkfahvpdilvnseynmetnevyafeelighsggiggtqgyfilcpsnweseeifgaenvykffmkeinkswnqsknk |
| Contig55_gene_10 | 697 | msqarnlekdvssskayfkgenelsinsninetkfnemtdsdsnffgtrfilnlsliklilkqmkvisqieiisnnqktskqfqykiiqkt l |

FIG. 9C-304

| | | |
|---|---|---|
| Contig55_gene_14 | 698 | mkkiylifpilagimfgstgifvrtltengidsttllflrfsiaiiymliaivltdkslikvskediplflicglclglnlcynnsintvpl slaavllstapvfvvifayfifnekissakvisiilviigcilttglleesmipitsiglisgigsaifwaiytiasrksidrgkhtftilfy sliiitivtipftnfggqiesfvlanpanniiflllhslisfalpyilitislnhldagtvvilssgepvaalvfgaivyneipsplmfcgiii tlialislsrkiemkse |
| Contig55_gene_27 | 699 | mhllwfyvaivlaisdeihsrivwgyvvrdfyivfggiissslds vmetwivheglealfhmifvsivffslkigflaalihflldvshsivir hmpwlphralhfvlecliffiavfgl |
| Contig55_gene_29 | 700 | mkhrlnldnkdpnyilkelikimdsrksksilasygfknlnrtiftfkiifismflgidisfilnelkskkelrkyfnisevltadqvykif seinseklikclnrilnlrnmvkrrgkktfivdatpvdvdinfhrnkktkehlekinlkwsyssskgyylgfkatvvldydsmnpvclivhsg apndaklfeeilenlqkrriirkgdtlifdkgyytyknyqigiskykiipfifpkefsrtlddiltyplavfnktkrimkekrlynslkme lmkkidswekfkpirgkiedffkllkqglnmreihkytpksvektvylnvflgaliisqgfysktiqqlsen |
| Contig55_gene_41 | 701 | mttvvytvsnavllmlfyswynlyekgviseerfgrknynsf |
| Contig55_gene_43 | 702 | mrkeriksylgiifdllvildliliifislpiqgihlidyagfvrafdlticflllieffyglyksdakakyfkehfldliasipfdliivfalf gssiilnlarflrlvrvvrvfravnivkkyglekvirrthadkifiviavivviftilltlsghenisdsfyfvvitlttvgygnegfnepl akfvtlfliivgvlvfstitgvtssffidkmleegisvdenlhfingklnfheremektrkelaeikkeleksnenseelkqeiselkelike nnk |

VACCINES AND VACCINE COMPONENTS FOR INHIBITION OF MICROBIAL CELLS

RELATED APPLICATIONS

This is a national phase application of PCT/NZ2008/000249, filed Sep. 25, 2008, which claims the benefit of U.S. Provisional Application No. 60/975,104, filed Sep. 25, 2007, U.S. Provisional Application No. 60/989,840, filed Nov. 22, 2007, and U.S. Provisional Application No. 60/989,841, filed Nov. 22, 2007, the contents of all of which are incorporated by reference herein in their entirety.

FIELD OF THE INVENTION

The invention relates to components from microbial cells which are useful for antibody production, including peptides, polypeptides comprising these peptides, polynucleotides which encode these peptides or polypeptides, and antibodies directed to these peptides, polypeptides, or polynucleotides. The invention also relates to expression vectors and host cells for producing these peptides, polypeptides, polynucleotides, and antibodies. The invention further relates to methods and compositions, especially vaccine compositions, for detecting, targeting, and inhibiting microbial cells, especially methanogen cells, using one or more of the disclosed peptides, polypeptides, polynucleotides, antibodies, expression vectors, and host cells.

BACKGROUND OF THE INVENTION

In New Zealand, agricultural activity accounts for the majority of greenhouse gas emissions. Therefore, reducing agricultural emissions of greenhouse gases is important for meeting New Zealand's obligations under the Kyoto Protocol. The Protocol requires reduction of greenhouse gases to 1990 levels by the end of the first commitment period (2008-2012). To this end, agricultural sector groups and the New Zealand government established the Pastoral Greenhouse Gas Research Consortium (PGGRC) to identify means for reducing New Zealand's agricultural greenhouse gas emissions.

An important part of the PGGRC's activities has been research into reducing methane emissions from New Zealand's grazing ruminants. Mitigating methane emissions from ruminants is of commercial interest for two reasons. First, failure to meet commitments under the Kyoto Protocol will force the government to purchase carbon credits. This is currently estimated to cost $350 million. Second, methane production results in the loss of 8-12% of the gross energy produced in the rumen. This energy could be used, instead, to improve ruminant productivity.

Methane is produced in the rumen by microbes called methanogens which are part of the phylum Euryarchaeota within the kingdom Archaea. Most methanogens grow on $CO_2$ and $H_2$ as their sole energy source, but some can use acetate or methyl compounds for growth. Several different genera of methanogenic archaea exist in the rumen, but species of the genus *Methanobrevibacter*, especially *M. ruminantium*, and *M. smithii* are thought to be the predominant methanogens in New Zealand ruminants. *M. ruminantium* is currently the subject of a genome sequencing project funded by the PGGRC. The project is the first genome sequencing of a rumen methanogen and it aims to build a better understanding of the biology of *Methanobrevibacter* to discover targets for inhibition of methane formation.

Reducing methane production in the rumen requires the inhibition of methanogens or the inactivation of their methanogenesis pathway. A means of inhibiting methane production is to identify specific molecules that inhibit methanogen cells. This may be achieved, for example, by use of agents which target methanogens. In one approach, vaccines can be prepared to target microbial cells. Therefore, it would be useful to identify components, especially cell-surface components from microbial cells, including peptides and polypeptides, and related polynucleotides and antibodies, that can be used for anti-microbial vaccines.

SUMMARY OF THE INVENTION

The invention features isolated peptides, polypeptides, and polynucleotides of *M. ruminantium*, particularly cell-surface components of *M. ruminantium*, as well as expression vectors, host cells, and antibodies, and methods of use thereof, as described in detail herein.

The invention specifically features an isolated peptide comprising, for example, at least a fragment of one amino acid sequence selected from the group consisting of SEQ ID NO:1-702. In a particular aspect, the peptide comprises at least a fragment of an amino acid sequence of any one of SEQ ID NO:45-260 and 332-702. In a further aspect, the peptide comprises at least a fragment of an amino acid sequence of any one of SEQ ID NO:10-17. In another aspect, the peptide is a fragment, for example, comprising at least one amino acid sequence encompassing an extracellular domain of any one of SEQ ID NO:10-17, 45-260, and 332-702.

The invention specifically features an isolated polypeptide comprising, for example, at least one amino acid sequence selected from the group consisting of SEQ ID NO:1-702. In a particular aspect, the polypeptide comprises the amino acid sequence of any one of SEQ ID NO: 45-260 and 332-702: In a further aspect, the polypeptide comprises the amino acid sequence of any one of SEQ ID NO:10-17. In another aspect, the polypeptide is a fragment, for example, comprising at least one amino acid sequence encompassing an extracellular domain of any one of SEQ ID NO:10-17, 45-260, and 332-702.

The invention additionally features an isolated polynucleotide comprising a coding sequence for at least one peptide. In one aspect, the polynucleotide comprises a coding sequence for at least a fragment of an amino acid sequence selected from the group consisting of SEQ ID NO:1-702. In a particular aspect, the polynucleotide comprises a coding sequence for at least a fragment of any one of SEQ ID NO:45-260 and 332-702. In a further aspect, the polynucleotide comprises a coding sequence for at least a fragment of any one of SEQ ID NO:10-17. In another aspect, the polynucleotide comprises a fragment of a coding sequence, for example, least one amino acid sequence encompassing an extracellular domain of any one of SEQ ID NO:10-17, 45-260, and 332-702.

The invention additionally features an isolated polynucleotide comprising a coding sequence for at least one polypeptide. In one aspect, the polynucleotide comprises a coding sequence for at least one amino acid sequence selected from the group consisting of SEQ ID NO:1-702. In a particular aspect, the polynucleotide comprises a coding sequence for any one of SEQ ID NO:45-260 and 332-702. In a further aspect, the polynucleotide comprises a coding sequence for any one of SEQ ID NO:10-17. In another aspect, the polynucleotide comprises a fragment of a coding sequence, for example, least one amino acid sequence encompassing an extracellular domain of any one of SEQ ID NO:10-17, 45-260, and 332-702.

In an additional aspect, the invention features an isolated polynucleotide comprising, for example, a nucleic acid sequence selected from the group consisting of SEQ ID NO:703-1395. In a particular aspect, the polynucleotide comprises the nucleic acid sequence of SEQ ID NO:703-710. In another aspect, the polynucleotide is a fragment or an oligonucleotide comprising, for example, the nucleic acid sequence encompassing an extracellular domain as encoded by any one of SEQ ID NO:703-710, 737-931, and 1003-1395. In addition, the invention encompasses an isolated polynucleotide, or fragment thereof, which hybridizes to any one of the nucleic acid sequences of SEQ ID NO:703-1395. The invention further encompasses an isolated polynucleotide comprising the complement, reverse complement, reverse sequence, or fragments thereof, of any one of the nucleic acid sequences.

The invention features an expression vector comprising a polynucleotide of the invention: In one aspect, the expression vector comprises a coding sequence for at least a fragment of an amino acid sequence selected from the group consisting of SEQ ID NO:1-702. In a particular aspect the expression vector comprises a coding sequence for at least a fragment of at least one of SEQ ID NO:45-260 and 332-702. In a further aspect, the expression vector comprises a coding sequence for at least one amino acid sequence of at least one of SEQ ID NO:10-17. In another aspect, the expression vector comprises a coding sequence for at least one amino acid sequence encompassing an extracellular domain of any one of SEQ ID NO: 10-17, 45-260, and 332-702.

The invention also features a host cell, for example, a microbial host cell, comprising at least one expression vector.

The invention specifically features an antibody directed to a peptide, polypeptide, or polynucleotide as disclosed herein. In certain aspects, the antibody is directed to an amino acid sequence selected from the group consisting of SEQ ID NO:1-702. In alternate aspects, the antibody is directed to at least a fragment of a polypeptide sequence selected from the group consisting of SEQ ID NO:10-17, 45-260, and 332-702. In a particular aspect, the antibody binds to at least a fragment of the peptide sequence of any one of SEQ ID NO:10-17. In a further aspect, the antibody binds to at least a fragment of the polypeptide sequence of any one of SEQ ID NO:45-260 and 332-702. In an alternate aspect, the antibody binds to at least a fragment of a peptide or polypeptide encompassing an extracellular domain of any one of SEQ ID NO:10-17, 45-260, and 332-702. In another aspect, the antibody includes one or more fusions or conjugates with at least one cell inhibitor, for example, anti-methanogenesis compounds (e.g., bromoethanesulphonic acid), antibodies and antibody fragments, lytic enzymes, peptide nucleic acids, antimicrobial Peptides, and other antibiotics as described in detail herein.

The invention additionally features modified peptides or polypeptides, e.g., for at least one of SEQ ID NO:1-702, including biologically active alterations, fragments, variants, and derivatives, described herein. Also featured are polynucleotides encoding these modified peptides or polypeptides, as well as alterations, fragments, variants, and derivatives of the disclosed polynucleotides; antibodies raised using these modified peptides, polypeptides, or polynucleotides; expression vectors comprising these polynucleotides; and host cells comprising these vectors. Further featured are modified antibodies, including biologically active alterations, fragments, variants, and derivatives, described herein. In specific aspects, the compositions and methods of the invention employ these modified peptides, polypeptides, polynucleotides, antibodies, or corresponding expression vectors or host cells.

The invention features a composition comprising an isolated peptide or polypeptide, e.g., at least one of SEQ ID NO:1-702. Also featured is a composition comprising an isolated polynucleotide, e.g., at least one of SEQ ID NO:703-1395. The invention additionally features a composition comprising an antibody, e.g., directed to a peptide, polypeptide, or polynucleotide sequence disclosed herein. Further featured is a composition that includes an expression vector, or host cell comprising an expression vector, in accordance with the invention. The composition can include any one of the biologically active alterations, fragments, variants, and derivatives described herein. The compositions can include at least one cell inhibitor (e.g., as a fusion or conjugate), and can be formulated, for example, as pharmaceutical compositions, in particular, vaccine compositions.

The invention also features a composition of the invention as part of a kit for targeting and/or inhibiting microbial cells, especially methanogen cells, in accordance with the disclosed methods. The kits comprise: a) at least one composition as set out herein; and b) optionally, instructions for use, for example, in targeting cells or inhibiting cell growth or replication for methanogens or other microbes.

The invention also features a method for producing a peptide or polypeptide, e.g., at least a fragment of any one of SEQ ID NO:1-702, the method comprising: a) culturing an expression vector or host cell comprising an expression vector, which comprises at least part of a coding sequence for at least one peptide or polypeptide under conditions suitable for the expression of the peptide or polypeptide; and b) recovering the peptide or polypeptide from the culture. In particular aspects, the peptide or polypeptide comprises at least one amino acid sequence selected from the group consisting of SEQ ID NO:1-702, or modified sequences thereof.

The invention also features a method for producing an antibody, e.g., directed to at least a fragment of any one of SEQ ID NO:1-702, the method comprising: a) culturing an expression vector or host cell comprising an expression vector, which comprises at least part of a coding sequence for at least one antibody or antibody fragment under conditions suitable for the expression of the antibody or antibody fragment; and b) recovering the amino acid sequence from the culture. In particular aspects, the antibody or antibody fragment is directed to at least one amino acid sequence selected from the group consisting of SEQ ID NO:1-702, or modified sequences thereof. In an alternate aspect, the antibody is produced by administration to a host animal, as described in detail herein.

The invention additionally features a method for producing an antibody, e.g., directed to at least a fragment of any one of SEQ ID NO:1-702, which comprises a fusion or conjugate with at least one cell inhibitor. Such method comprises: a) culturing an expression vector or host cell comprising an expression vector, which comprises a coding sequence for at least one antibody or antibody fragment under conditions suitable for the expression of the antibody or antibody fragment; b) forming a fusion or conjugate to the antibody or antibody fragment (e.g., by expression of the fused sequence or chemical conjugation to the cell inhibitor); and c) recovering the fusion or conjugate.

In particular aspects, the antibody is directed to at least a fragment of any one of SEQ ID NO:1-702, or modified sequences thereof. In further aspects, the inhibitor is selected from anti-methanogenesis compounds (e.g., bromoethanesulphonic acid), antibodies and antibody fragments, lytic enzymes, peptide nucleic acids, antimicrobial peptides, and other antibiotics as described in detail herein. In an alternate aspect, the antibody is produced by administration to a host animal and then conjugated, as described in detail herein.

In addition, the invention features a method of inhibiting (e.g., inhibiting growth or replication) of a microbial cell, in particular, a methanogen cell, comprising: contacting the cell with antibody or antibody fragment, e.g., directed to at least a fragment of any one of SEQ ID NO:1-702, or an antibody fusion or conjugate, or any modified antibody.

As another method, the cell is inhibited by administration of a vaccine composition as described in detail herein.

The invention further features a method of inhibiting (e.g., inhibiting growth or replication) of a microbial cell, in particular, a methanogen cell, comprising: a) optionally, producing or isolating at least one antibody as disclosed herein; and b) contacting the cell with the antibody. In a particular aspect, the antibody is directed to at least a fragment of any one of SEQ ID NO:1-702, or a modified sequence thereof. In certain aspects, the antibody further comprises at least one cell inhibitor, attached, for example, as a fusion or conjugate. In other aspects, the antibody is administered to a subject as a composition, e.g., a vaccine composition.

Additionally, the invention features a method of inhibiting (e.g., inhibiting growth or replication) of a microbial cell, in particular, a methanogen cell, comprising: a) optionally, producing or isolating at least one peptide or polypeptide as disclosed herein; and b) administering the peptide or polypeptide to a subject to induce an immune response thereto. In a particular aspect, the peptide or polypeptide comprises at least one amino acid sequence selected from the group consisting of SEQ ID NO:1-702, or a modified sequence thereof. In other aspects, the peptide or polypeptide is administered to a subject as a composition, e.g., a vaccine composition.

The invention furthermore features a method of detecting and/or measuring the levels of a polypeptide, in particular, a cell surface polypeptide, or corresponding peptides or polynucleotides, comprising: 1) contacting a sample from a subject with an antibody directed to the polypeptide (e.g., at least a fragment of any one of SEQ ID NO:1-702, or a modified sequence thereof), or a corresponding peptide or polynucleotide (e.g., at least a fragment of one of SEQ ID NO:703-1395, or a modified sequence thereof); and 2) determining the presence or levels of the antibody complex formed with the corresponding polypeptide, peptide, or polynucleotide in the sample. Such methods can also be used for detecting and/or measuring the levels of a microbial cell, in particular, a methanogen cell.

The invention also features a method of detecting and/or measuring the levels of a polynucleotide, in particular, a polynucleotide encoding a cell surface component, comprising: 1) contacting a sample from a subject with a complementary polynucleotide (e.g., a sequence complementary to at least a fragment of any one of SEQ ID NO:703-1395, or a modified sequence thereof); and 2) determining the presence or levels of the hybridization complex formed with the polynucleotide in the sample. Such methods can also be used for detecting and/or measuring the levels of a microbial cell, in particular, a methanogen cell.

In particular aspects, the methods of the invention utilize in vivo or in vitro expression components. In other aspects, the methods employ peptides, polypeptides, polynucleotides, or antibodies produced by recombinant, synthetic, or semi-synthetic means, or by endogenous means.

Other aspects and embodiments of the invention are described herein below.

BRIEF DESCRIPTION OF THE DRAWINGS

This invention is described with reference to specific embodiments thereof and with reference to the figures.

FIGS. 1A-1C. Comparison of *Methanobacteriales* genomes (FIG. 1A); *M. ruminantium* genome statistics (FIG. 1B); Genes predicted to be involved in methanogenesis in *Methanobacteriales* species (FIG. 1C).

FIG. 2. Vaccination protocol.

FIG. 3. Sheep antibody responses to vaccination with *M. ruminantium* cell wall preparation and peptides designed against *M. ruminantium* mtr and cell surface proteins.

FIG. 4. Peptide sequences used for antibody production.

FIGS. 5A-5B. ORFs selected for antibody production: Nucleotide sequences (FIG. 5A); Amino acid sequences (FIG. 5B).

FIGS. 6A-6C. ORFs encoding methanogenesis pathway enzymes identified from *M. ruminantium*: Annotation (FIG. 6A); Nucleotide sequences (FIG. 6B); Amino acid sequences (FIG. 6C).

FIGS. 7A-7C. ORFs for cell surface proteins identified from *M. ruminantium*: Annotation (FIG. 7A); Nucleotide sequences (FIG. 7B); Amino acid sequences (FIG. 7C).

FIGS. 8A-8C. ORFs encoding the biosynthesis of exopolysaccharides identified from *M. ruminantium*: Annotation (FIG. 8A); Nucleotide sequences (FIG. 8B); Amino acid sequences (FIG. 8C).

FIGS. 9A-9C. ORFs comprising membrane-spanning domains identified from *M. ruminantium*: Annotation (FIG. 9A); Nucleotide sequences (FIG. 9B); Amino acid sequences (FIG. 9C).

DETAILED DESCRIPTION OF THE INVENTION

Definitions

Figure 1C:
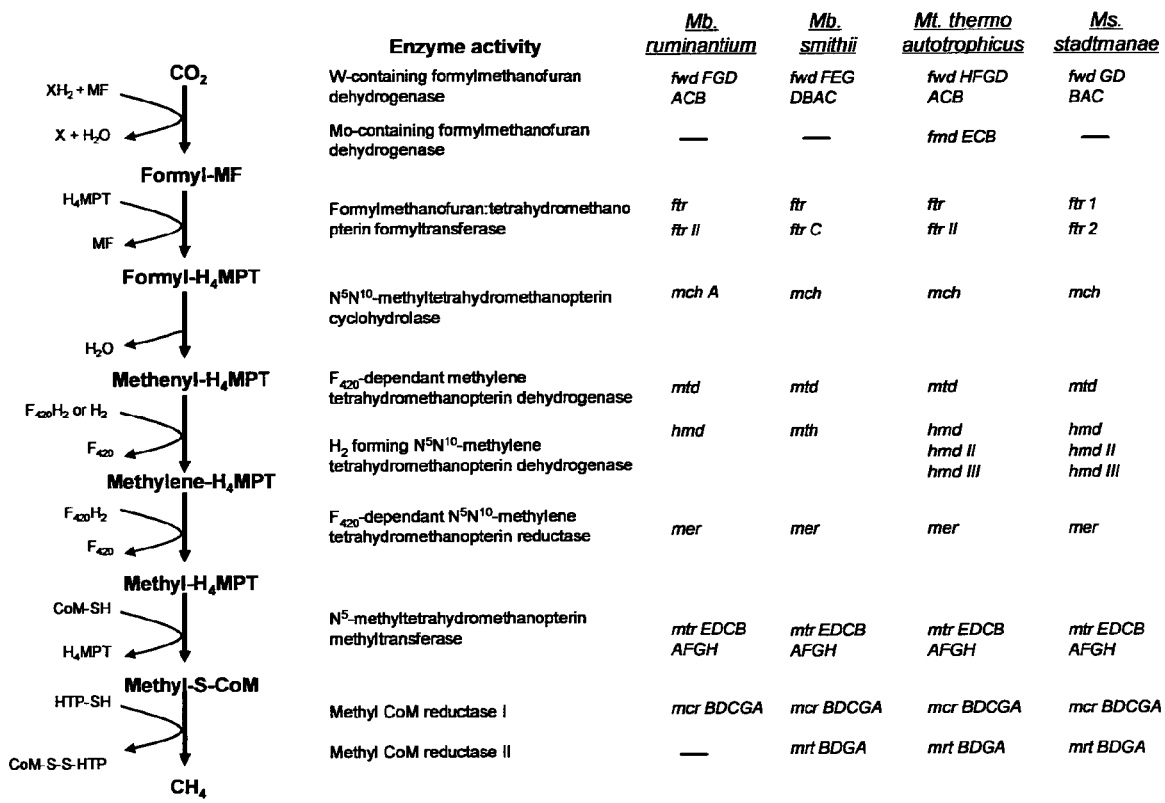

The term "antibody" should be understood in the broadest possible sense and is intended to include intact monoclonal antibodies and polyclonal antibodies. It is also intended to cover fragments and derivatives of antibodies so long as they exhibit the desired biological activity. Antibodies encompass immunoglobulin molecules and immunologically active portions of immunoglobulin (Ig) molecules, i.e., molecules that contain an antigen binding site that specifically binds (immunoreacts with) an antigen. These include, but are not limited to, polyclonal, monoclonal, chimeric, single chain, Fc, Fab, Fab', and $Fab_2$ fragments, and a Fab expression library.

Antibody molecules relate to any of the classes IgG, IgM, IgA, IgE, and IgD, which differ from one another by the nature of heavy chain present in the molecule. These include subclasses as well, such as IgG1, IgG2, and others. The light chain may be a kappa chain or a lambda chain. Reference herein to antibodies includes a reference to all classes, subclasses, and types. Also included are chimeric antibodies, for example, monoclonal antibodies or fragments thereof that are specific to more than one source, e.g., one or more mouse, human, or ruminant sequences. Further included are camelid antibodies or nanobodies. It will be understood that each reference to "antibodies" or any like term, herein includes intact antibodies, as well as any fragments, alterations, derivatives, or variants thereof.

"Altered" nucleic acid sequences encoding peptides, polypeptides, or antibodies, as used herein, include those with deletions, insertions, or substitutions of different nucleotides resulting in a polynucleotide that encodes the same or functionally equivalent sequence. The encoded peptide, polypeptide, or antibody may also be "altered" and contain deletions, insertions, or substitutions of amino acid residues which produce a silent change and result in a functionally equivalent sequence. Deliberate amino acid substitutions may be made on the basis of similarity in polarity, charge, solubility, hydrophobicity, hydrophilicity, and/or the amphipathic nature of the residues as long as the biological activity (e.g., cell association, membrane association) or immunogenic/immunological activity is retained. For example, negatively charged amino acids may include aspartic acid and glutamic acid; positively charged amino acids may include lysine and arginine; and amino acids with uncharged polar head groups having similar hydrophilicity values may include leucine, isoleucine, and valine, glycine and alanine, asparagine and glutamine, serine and threonine, and phenylalanine and tyrosine.

"Amino acid sequence", as used herein, refers to a sequence of an oligopeptide, peptide, polypeptide, protein or antibody, and any fragment thereof, and to any naturally occurring, recombinant, synthetic, or semi-synthetic molecules. The sequences of the invention comprise at least 5, 10, 15, 20, 25, 30, 35, 40, 45, 50, 100, 150, 200, 250 amino acids, preferably at least 5 to 10, 10 to 20, 20 to 30, 30 to 40, 40 to 50, 50 to 100, 100 to 150, 150 to 200, or 200 to 250 amino acids. Sequences retain the biological activity (e.g., effect on cell growth and/or proliferation) or the immunogenicity/immunological activity of the amino acid sequence. "Amino acid sequence" and like terms are not limited to the complete, native amino acid sequence associated with the full-length molecule, but include also any fragments, alterations, derivatives, and variants thereof.

"Amplification", as used herein, refers to the production of additional copies of a nucleic acid sequence and is generally carried out using polymerase chain reaction (PCR) technologies well known in the art (Dieffenbach, C. W. and G. S. Dveksler (1995) PCR Primer, a Laboratory Manual, Cold Spring Harbor Press, Plainview, N.Y.).

The terms "biologically active" or "functional," as used herein, refer to a peptide or polypeptide retaining one or more structural, immunogenic, or biochemical functions (e.g., cell association, membrane association) of a naturally occurring sequence.

The terms "cell inhibitor" or "inhibitor," as used herein, refer to agents that decrease or block the growth or replication of microbial cells, especially methanogen cells. A cell inhibitor can act to decrease or block, for example, cellular division. An inhibitor can decrease or block, for example, DNA synthesis, RNA synthesis, protein synthesis, or post-translational modifications. An inhibitor can also decrease or block the activity of enzymes involved in the methanogenesis pathway. An inhibitor can also target a cell for recognition by immune system components. Inhibition of a cell also includes cell killing and cell death, for example, from lysis, apoptosis, necrosis, etc. Useful inhibitors include, but are not limited to, anti-methanogenesis compounds (e.g., bromoethanesulphonic acid), antibodies and antibody fragments, lytic enzymes, peptide nucleic acids, antimicrobial peptides, and other antibiotics as described in detail herein.

The terms "complementary" or "complementarity," as used herein, refer to the natural binding of polynucleotides under permissive salt and temperature conditions by base-pairing. For the sequence A-G-T, the complementary sequence is T-C-A, the reverse complement is A-C-T and the reverse sequence is T-G-A. Complementarity between two single stranded molecules may be partial, in which only some of the nucleic acids bind, or it may be complete when total complementarity exists between the single stranded molecules. The degree of complementarity between nucleic acid strands has significant effects on the efficiency and strength of hybridization between nucleic acid strands. This is of particular importance in amplification reactions, which depend upon binding between nucleic acids strands and in the design and use of PNA molecules.

The term "derivative", as used herein, refers to the chemical modification of a nucleic acid encoding a peptide, polypeptide, or antibody, or a nucleic acid complementary thereto. Such modifications include, for example, replacement of hydrogen by an alkyl, acyl, or amino group. In preferred aspects, a nucleic acid derivative encodes a peptide, polypeptide, or antibody which retains a biological or immunogenicity/immunological activity of the natural molecule. A derivative peptide, polypeptide, or antibody is one which is modified by glycosylation, pegylation, or any similar process which retains one or more biological function (e.g., cell association, membrane association) or immunogenicity/immunological activity of the sequence from which it was derived.

The term "homology", as used herein, refers to a degree of complementarity. There may be partial homology. (i.e., less than 100% identity) or complete homology (i.e., 100% identity). A partially complementary sequence that at least partially inhibits an identical sequence from hybridizing to a target nucleic acid is referred to using the functional term "substantially homologous." The inhibition of hybridization of the completely complementary sequence to the target sequence may be examined using a hybridization assay (e.g., Southern or northern blot, solution hybridization and the like) under conditions of low stringency. A substantially homologous sequence or hybridization probe will compete for and inhibit the binding of a completely homologous sequence to the target sequence under conditions of low stringency. This is not to say that conditions of low stringency are such that non-specific binding is permitted; low stringency conditions require that the binding of two sequences to one another be a specific (i.e., selective) interaction.

The term "hybridization", as used herein, refers to any process by which a strand of nucleic acid binds with a complementary strand through base pairing.

An "insertion" or "addition", as used herein, refers to a change in an amino acid or nucleotide sequence resulting in the addition of one or more amino acid residues or nucleotides, respectively, as compared to the naturally occurring molecule.

A "methanogen," as used herein, refers to microbes that produce methane gas, which include *Methanobrevibacter*, *Methanothermobacter*, *Methanomicrobium*, *Methanobacterium*, and *Methanosarcina*. Specific methanogens include, but are not limited to, *Methanobrevibacter ruminantium* (i.e., M1 strain, or strain DSM1093), *Methanobrevibacter smithii*, *Methanobrevibacter acididurans*, *Methanobrevibacter thaueri*, *Methanobacterium blyantii*, *Methanobacterium formicicum*, *Methanothermobacter marburgensis*, *Methanothermobacter wolfeii*, *Methanosphaera stadtmanae*, *Methanomicrobium mobile*, *Methanosarcina barked*, *Methanosarcina mazei*, *Methanococcoides burtonii*, and *Methanolobus taylorii*. All methanogen genera and species are encompassed by this term.

"Microbial" cells as used herein, refers to naturally-occurring or genetically modified microbial cells including archaebacteria such as methanogens, halophiles, and thermoacidophiles, and eubacteria, such as cyanobacteria, spirochetes, proteobacteria, as well as Gram positive and Gram negative bacteria.

The term "modified" refers to altered sequences and to sequence fragments, variants, and derivatives, as described herein.

"Nucleic acid sequence" or "nucleotide sequence" as used herein, refers to a sequence of a polynucleotide, oligonucleotide, or fragments thereof, and to DNA or RNA of natural, recombinant, synthetic or semi-synthetic, origin which may be single or double stranded, and can represent sense or antisense strand, or coding or non-coding regions. The sequences of the invention, preferably, comprise at least 12, 15, 30, 45, 60, 75, 90, 105, 120, 135, 150, 300, 450, 600, 750 nucleotides, preferably at least 15 to 30, 30 to 60, 60 to 90, 90 to 120, 120 to 150, 150 to 300, 300 to 450, 450 to 600, or 600 to 750 nucleotides, or at least 1000 nucleotides, or at least 1500 nucleotides. It will be understood that each reference to a "nucleic acid sequence" or "nucleotide sequence," herein, will include the native, full length sequence, as well as any complements, fragments, alterations, derivatives, or variants, thereof.

The term "oligonucleotide" refers to a nucleic acid sequence of at least 6, 8, 10, 12, 15, 18, 21, 25, 27, 30, or 36 nucleotides, or at least 12 to 36 nucleotides, or at least 15 to 30 nucleotides, which can be used in PCR amplification, sequencing, or hybridization assays. As used herein, oligonucleotide is substantially equivalent to the terms "amplimers," "primers," "oligomers," and "probes," as commonly defined in the art.

The term "polynucleotide," when used in the singular or plural, generally refers to any nucleic acid sequence, e.g., any polyribonucleotide or polydeoxyribonucleotide, which may be unmodified RNA or DNA or modified RNA or DNA. This includes, without limitation, single and double stranded DNA, DNA including single and double stranded regions, single and double stranded RNA, and RNA including single and double stranded regions, hybrid molecules comprising DNA and RNA that may be single stranded or, more typically, double stranded or include single and double stranded regions. Also included are triple-stranded regions comprising RNA or DNA or both RNA and DNA. Specifically included are mRNAs, cDNAs, and genomic DNAs, and any fragments thereof. The term includes DNAs and RNAs that contain one or more modified bases, such as tritiated bases, or unusual bases, such as inosine. The polynucleotides of the invention can encompass coding or non-coding sequences, or sense or antisense sequences, or iRNAs such as siRNAs. It will be understood that each reference to a "polynucleotide" or like term, herein, will include the full length sequences as well as any complements, fragments, alterations, derivatives, or variants thereof.

A "peptide" and "polypeptide," as used herein, refer to the isolated peptides or polypeptides of the invention obtained from any species, preferably microbial, from any source whether natural, synthetic, semi-synthetic, or recombinant. Specifically, a peptide or polypeptide of the invention can be obtained from methanogen cells, such as *Methanobrevibacter* cells, in particular, *M. ruminantium*, or *M. smithii* cells. For recombinant production, a peptide or polypeptide of the invention can be obtained from microbial or eukaryotic cells, for example, *Escherichia, Streptomyces, Bacillus, Salmonella,* yeast, insect cells such as *Drosophila,* animal cells such as COS and CHO cells, or plant cells. It will be understood that each reference to a "peptide" or "polypeptide," herein, will include the full-length sequence, as well as any fragments, alterations, derivatives, or variants, thereof.

"Peptide nucleic acid" or "PNA" as used herein, refers to an antisense molecule or anti-gene agent which comprises bases linked via a peptide backbone.

The term "ruminant," as used herein, refers to animals that have a rumen as a special type of digestive organ. Ruminants include, but are not limited to, cattle, sheep, goats, buffalo, moose; antelope, caribou, and deer.

The terms "stringent conditions" or "stringency," as used herein, refer to the conditions for hybridization as defined by the nucleic acid, salt, and temperature. These conditions are well known in the art and may be altered in order to identify or detect identical or related polynucleotide sequences. See, e.g., Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York, N.Y. Numerous equivalent conditions comprising either low or high stringency depend on factors such as the length and nature of the sequence (DNA, RNA, base composition), nature of the target (DNA, RNA, base composition), milieu (in solution or immobilized on a solid substrate), concentration of salts and other components (e.g., formamide, dextran sulfate and/or polyethylene glycol), and temperature of the reactions (e.g., within a range from about 5° C. below the melting temperature of the probe to about 20° C. to 25° C. below the melting temperature). One or more factors may be varied to generate conditions of either low or high stringency different from, but equivalent to, the above listed conditions.

The term "subject" includes human and non-human animals. Non-human animals include, but are not limited to, birds and mammals, such as ruminants, and in particular, mice, rabbits, cats, dogs, pigs, sheep, goats, cows, and horses.

The terms "substantially purified" or "isolated" as used herein, refer to nucleic acid or amino acid sequences that are removed from their cellular, recombinant, or synthetic environment, and are at least 60% free, preferably 75% free, and most preferably at least 90% free or at least 99% free from other components with which they are associated in their environment. "Isolated" polynucleotides and polypeptides have been identified and separated from at least one contaminant molecule with which they are associated in their natural state. Accordingly, it will be understood that isolated polynucleotides and polypeptides are in a form which differs from the form or setting in which they are found in nature. It will further be appreciated that "isolated" does not necessarily reflect the exact extent (e.g., a specific percentage) to which the sequence has been purified.

"Transformation," as defined herein, describes a process by which exogenous DNA enters and changes a recipient cell. It may occur under natural or artificial conditions using various methods well known in the art. Transformation may rely on any known method for the insertion of foreign nucleic acid sequences into a prokaryotic or eukaryotic host cell. The method is selected based on the type of host cell being transformed and may include, but is not limited to, viral infection, electroporation, heat shock, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time.

"Vaccines" as used herein include all components and compositions for stimulating the immune response in a subject. Particularly useful in this regard are subunit vaccines, including peptide vaccines, and also vectored vaccines, nucleic acid vaccines, and edible vaccines. Vaccines can be used to establish or strengthen an immune response to an antigen, particularly a microbial antigen. In particular aspects, vaccines comprise antigens that evoke host-protective reactions, e.g., antibody formation, T helper, and T cell responses. Vaccines can also comprise antibodies, for example, for passive immunization.

A "variant" of a peptide, polypeptide, or antibody, as used herein, refers to an amino acid sequence that is altered by one or more amino acids. A variant polynucleotide is altered by one or more nucleotides. A variant may result in "conservative" changes, wherein a substituted amino acid has similar structural or chemical properties, e.g., replacement of leucine with isoleucine. More rarely, a variant may result in "nonconservative" changes, e.g., replacement of a glycine with a tryptophan. Analogous minor variations may also include amino acid deletions or insertions, or both. Guidance in determining which amino acid residues may be substituted, inserted, or deleted without abolishing biological or immunogenic/immunological activity may be found using computer programs well known in the art, for example, LASERGENE software (DNASTAR).

The invention also encompasses variants which retain at least one biological activity (e.g., cell association, membrane association) or immunogenicity/immunological activity. A preferred variant is one having substantially the same or a functionally equivalent sequence, for example, having at least 80%, and more preferably at least 90%, sequence identity to a disclosed sequence. A most preferred variant is one having at least 95%, at least 97%, at least 98%, or at least 99% sequence identity to a sequence disclosed herein. The percentage identity is determined by aligning the two sequences to be compared as described below, determining the number of identical residues in the aligned portion, dividing that number by the total number of residues in the inventive (queried) sequence, and multiplying the result by 100. A useful alignment program is AlignX (Vector NTI).

DESCRIPTION OF THE INVENTION

Methane is produced in the foregut of ruminants by methanogens which act as terminal reducers of carbon in the rumen system. The multi-step methanogenesis pathway is well elucidated, mainly from the study of non-rumen methanogens, but the adaptations that allow methanogens to grow and persist in the rumen are not well understood. *Methanobrevibacter ruminantium* is a prominent methanogen in New Zealand ruminants. As described herein, the genome of *M. ruminantium* has been sequenced and shown as approximately 3.0 Mb in size with a GC content of 33.68%. All of the components of the methanogenesis pathway have been identified and comparison of these gene sequences with those from *Methanobacterium thermoautotrophicum* and *Methanosphaera stadtmanae* indicates methanogenesis gene Organisation is conserved within the *Methanobacteriales* (FIG. 1C). The genome contains many large surface proteins with characteristics that indicate that they may mediate association with other rumen microbes. In various aspects of the invention, the identified polynucleotides and polypeptides can be used as a means for inhibiting methanogens and/or methanogenesis in the rumen, and to further elucidate the role of *M. ruminantium* in methane formation. Particularly useful are the disclosed polynucleotides and polypeptides identified as components involved in methanogenesis (FIGS. 6A-6C), as cell surface components (FIGS. 7A-7C), as components involved in exopolysaccharide biosynthesis (FIGS. 8A-8C), as components with membrane spanning domains (FIGS. 9A-9C), as well as the polynucleotides and polypeptides used for antibody production (FIGS. 5A-5B).

Peptides, Polypeptides, and Polynucleotides

The invention encompasses peptides and polypeptides, including those comprising at least one of SEQ ID NO:1-702, and fragments, variants, and derivatives thereof. The peptides and polypeptides of the present invention may be expressed and used in various assays to determine their biological activity. The peptides and polypeptides may be used for large-scale synthesis and isolation protocols, for example, for commercial production. Such peptides and polypeptides may be used to raise antibodies, to isolate corresponding amino acid sequences, and to quantitatively determine levels of the amino acid sequences. The peptides and polypeptides can be used for vaccines for targeting and inhibiting microbial cells, especially methanogen cells. The peptides and polypeptides can also be used for preparing antibodies to inhibit the growth or replication of such cells. The peptides and polypeptides of the present invention may also be used as compositions, for example, pharmaceutical compositions, especially vaccine compositions. In particular aspects, slow-release ruminal devices can be used in conjunction with the peptides, polypeptides, antibodies, and compositions (e.g., pharmaceutical compositions, especially vaccine compositions) of the invention.

The peptides of the present invention comprise at least one sequence selected from the group consisting of: (a) peptides comprising at least a fragment of an one amino acid sequence selected from the group consisting of SEQ ID NO:1-702, or fragments, variants, or derivatives thereof; (b) peptides comprising a functional domain of at least one amino acid sequence selected from the group consisting of SEQ ID NO:1-702, and fragments and variants thereof; and (c) peptides comprising at least a specified number of contiguous residues of at least one amino acid sequence selected from the group consisting of SEQ ID NO:1-702, or variants or derivatives thereof. In one embodiment, the invention encompasses an isolated peptide comprising the amino acid sequence of at least one of SEQ ID NO:1-9. All of these sequences are collectively referred to herein as peptides of the invention.

The polypeptides of the present invention comprise at least one sequence selected from the group consisting of: (a) polypeptides comprising at least one amino acid sequence selected from the group consisting of SEQ ID NO:1-702, or fragments, variants, or derivatives thereof; (b) polypeptides comprising a functional domain of at least one amino acid sequence selected from the group consisting of SEQ ID NO:1-702, and fragments and variants thereof; and (c) polypeptides comprising at least a specified number of contiguous residues of at least one amino acid sequence selected from the group consisting of SEQ ID NO:1-702, or variants or derivatives thereof. In one embodiment, the invention encompasses an isolated polypeptide comprising the amino acid sequence of at least one of SEQ ID NO:1-9. All of these sequences are collectively referred to herein as polypeptides of the invention.

The invention also encompasses an isolated polynucleotide that encodes a peptide or polypeptide of SEQ ID NO:1-702. The isolated polynucleotides of the present invention have utility in genome mapping, in physical mapping, and in cloning of genes of more or less related cell surface components. Probes designed using the polynucleotides of the present invention may be used to detect the presence and examine the expression patterns of genes in any organism having sufficiently homologous DNA and RNA sequences in their cells, using techniques that are well known in the art, such as slot blot techniques or microarray analysis. Primers designed using the polynucleotides of the present invention may be used for sequencing and PCR amplifications. The polynucleotides of the invention can be used for preparing expression vectors and host cells for vaccines to target and inhibit microbial cells, especially methanogen cells. The invention further encompasses the use of the polynucleotides for the production of antibodies to inhibit the growth or replication of such cells. The polynucleotides of the present invention may also be used as compositions, for example, pharmaceutical compositions, especially vaccine compositions. In particular aspects, slow-release ruminal devices can be used in conjunction with the polynucleotides, vectors, host cells, and compositions (e.g., pharmaceutical compositions, especially vaccine compositions) of the invention.

The polynucleotides of the present invention comprise at least one sequence selected from the group consisting of: (a) sequences comprising a coding sequence for at least one amino acid sequence selected from the group consisting of SEQ ID NO:1-702, or fragments or variants thereof; (b) complements, reverse sequences, and reverse complements of a coding sequence for at least one amino acid sequence selected from the group consisting of SEQ ID NO:1-702, or fragments or variants thereof; (c) open reading frames contained in the coding sequence for at least one amino acid sequence selected from the group consisting of SEQ ID NO:1-702, and their fragments and variants; (d) functional domains of a coding sequence for at least one amino acid sequence selected from the group consisting of SEQ ID NO:1-702, and fragments and variants-thereof; and (e) sequences comprising at least a specified number of contiguous residues of a coding sequence for at least one amino acid sequence selected from the group consisting of SEQ ID NO:1-702, or variants thereof; and (f) sequences comprising at least a specified number of contiguous nucleotides of any one of SEQ ID NO:703-1395. Oligonucleotide probes and primers and their variants are also provided. All of these polynucleotides and oligonucleotide probes and primers are collectively referred to herein, as polynucleotides of the invention.

It will be appreciated by those skilled in the art that as a result of the degeneracy of the genetic code; a multitude of nucleotide sequences encoding the peptides or polypeptides of the invention, some bearing minimal homology to the nucleotide sequences of any known and naturally occurring gene, may be produced. Thus, the invention contemplates each and every possible variation of nucleotide sequence that could be made by selecting combinations based on possible codon choices. These combinations, are made in accordance with the standard triplet genetic code as applied to naturally occurring amino acid sequences, and all such variations are to be considered as being specifically disclosed.

Nucleotide sequences which encode the peptides or polypeptides, or their fragments or variants, are preferably capable of hybridizing to the nucleotide sequence of the naturally occurring sequence under appropriately selected conditions of peptide or stringency. However, it may be advantageous to produce nucleotide sequences encoding a peptide or polypeptide, or its fragment or derivative, possessing a substantially different codon usage. Codons may be selected to increase the rate at which expression of the peptide or polypeptide occurs in a particular prokaryotic or eukaryotic host in accordance with the frequency with which particular codons are utilized by the host. Other reasons for substantially altering the nucleotide sequence encoding peptides or polypeptides and its derivatives without altering the encoded amino acid sequences include the production of RNA transcripts having more desirable properties, such as a greater half-life, than transcripts produced from the naturally occurring sequence.

The invention also encompasses production of DNA sequences, or fragments thereof, which encode the peptides or polypeptides, or their fragments or variants, entirely by synthetic chemistry. After production, the synthetic sequence may be inserted into any of the many available expression vectors and cell systems using reagents that are well known in the art. Moreover, synthetic chemistry may be used to introduce mutations into a sequence encoding a peptide or polypeptide, or any variants or fragment thereof. Also encompassed by the invention are polynucleotide sequences that are capable of hybridizing to the claimed nucleotide sequences, and in particular, those shown in SEQ ID NO:703-1395, under various conditions of stringency as taught in Wahl, G. M. and S. L. Berger (1987; Methods Enzymol. 152:399-407) and Kimmel, A: R. (1987; Methods Enzymol. 152:507-511).

Methods for DNA sequencing which are well known and generally available in the art and may be used to practice any of the embodiments of the invention. The methods may employ such enzymes as the Klenow fragment of DNA polymerase I, SEQUENASE (U.S. Biochemical Corp, Cleveland, Ohio), Taq polymerase (Perkin Elmer), thermostable T7 polymerase Amersham Pharmacia Biotech (Piscataway, N.J.), or combinations of polymerases and proofreading exonucleases such as those found in the ELONGASE Amplification System marketed by Life Technologies (Gaithersburg, Md.). Preferably, the process is automated with machines such as the Hamilton Micro Lab 2200 (Hamilton, Reno, Nev.), Peltier Thermal Cycler (PTC200; MJ Research, Watertown, Mass.) the ABI Catalyst and 373 and 377 DNA Sequencers (Perkin Elmer); or the Genome Sequencer 20™ (Roche Diagnostics).

The nucleic acid sequences encoding the peptides or polypeptides may be extended utilizing a partial nucleotide sequence and employing various methods known in the art to detect upstream sequences such as promoters and regulatory elements. For example, one method which may be employed, "restriction-site" PCR, uses universal primers to retrieve unknown sequence adjacent to a known locus (Sarkar, G. (1993) PCR Methods Applic. 2:318-322). In particular, genomic DNA is first amplified in the presence of primer to a linker sequence and a primer specific to the known region. The amplified sequences are then subjected to a second round of PCR with the same linker primer and another specific primer internal to the first one. Products of each round of PCR are transcribed with an appropriate RNA polymerase and sequenced using reverse transcriptase.

Capillary electrophoresis systems which are commercially available may be used to analyze the size or confirm the nucleotide sequence of sequencing or PCR products. In particular, capillary sequencing may employ flowable polymers for electrophoretic separation, four different fluorescent dyes (one for each nucleotide) which are laser activated, and defection of the emitted wavelengths by a charge coupled device camera. Output/light intensity may be converted to electrical signal using appropriate software (e.g. GENOTYPER and Sequence NAVIGATOR, Perkin Elmer) and the entire process from loading of samples to computer analysis and electronic data display may be computer controlled. Capillary electrophoresis is especially preferable for the sequencing of small pieces of DNA which might be present in limited amounts in a particular sample.

In another embodiment of the invention, polynucleotides or fragments thereof which encode peptides or polypeptides may be used in recombinant DNA molecules to direct expression of the peptides or polypeptides, or fragments or variants thereof, in appropriate host cells. Due to the inherent degeneracy of the genetic code, other DNA sequences which encode substantially the same or a functionally equivalent amino acid sequence may be produced, and these sequences may be used to clone and express peptides or polypeptides. The nucleotide sequences of the present invention can be engineered using methods generally known in the art in order to alter amino acid-encoding sequences for a variety of reasons, including but not limited to, alterations which modify the cloning, processing, and/or expression of the gene product. DNA shuffling by random fragmentation and PCR reassembly of gene fragments and synthetic oligonucleotides may be used to engineer the nucleotide sequences. For example, site-directed mutagenesis may be used to insert new restriction sites, alter glycosylation patterns, change codon preference, introduce mutations, and so forth.

In another embodiment of the invention, natural, modified, or recombinant nucleic acid sequences encoding peptides or polypeptides may be ligated to a heterologous sequence to encode a fusion protein. For example, it may be useful to encode a chimeric sequence that can be recognized by a commercially available antibody. A fusion protein may also be engineered to contain a cleavage site located between the peptide or polypeptide of the invention and the heterologous protein sequence, so that the peptide or polypeptide may be cleaved and purified away from the heterologous moiety.

In another embodiment, sequences encoding peptides or polypeptides may be synthesized, in whole or in part, using chemical methods well known in the art (see Caruthers, M. H. et al. (1980) Nucl. Acids Res. Symp. Ser. 215-223, Horn, T. et al. (1980) Nucl. Acids Res. Symp. Ser. 225-232). Alternatively, the polypeptide itself may be produced using chemical methods to synthesize the amino acid sequence, or a fragment thereof. For example, polypeptide synthesis can be performed using various solid-phase techniques (Roberge, J. Y. et al. (1995) Science 269:202-204; Merrifield J. (1963) J. Am. Chem. Soc. 85:2149-2154) and automated synthesis may be achieved, for example, using the ABI 431A Peptide Synthesizer (Perkin Elmer). Various fragments of peptides or polypeptides may be chemically synthesized separately and combined using chemical methods to produce the full length molecule.

The newly synthesized peptide or polypeptide may be isolated by preparative high performance liquid chromatography (e.g., Creighton, T. (1983) Proteins Structures and Molecular Principles, WH Freeman and Co., New York, N.Y.). The composition of the synthetic peptides or polypeptides may be confirmed by amino acid analysis or sequencing (e.g., the Edman degradation procedure; Creighton, supra). Additionally, the amino acid sequence of the peptide or polypeptide, or any part thereof, may be altered during direct synthesis and/or combined using chemical methods with sequences from other proteins, or any part thereof, to produce a variant molecule.

In order to express a biologically active peptides or polypeptides, the nucleotide sequences encoding the sequences or functional equivalents, may be inserted into an appropriate expression vector, i.e., a vector which contains the necessary elements for the transcription and translation of the inserted coding sequence. Methods which are well known to those skilled in the art may be used to construct expression vectors containing sequences encoding the peptide or polypeptide and appropriate transcriptional and translational control elements. These methods include in vitro recombinant DNA techniques, synthetic techniques, and in vivo genetic recombination. Such techniques are described in Sambrook, J. et al. (1989) Molecular Cloning, A Laboratory Manual, Cold Spring Harbor Press, Plainview, N.Y., and Ausubel, F. M. et al. (1989) Current Protocols in Molecular Biology, John Wiley 8, Sons, New York, N.Y.

A variety of expression vector/host systems may be utilized to contain and express sequences encoding the peptides or polypeptides of the invention. These include, but are not limited to, microorganisms such as bacteria transformed with recombinant phage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems. For bacteria, useful plasmids include pET, pRSET, pTrcHis2, and pBAD plasmids from Invitrogen, pET and pCDF plasmids from Novagen, and Director plasmids from Sigma-Aldrich. For methanogens, useful plasmids include, but are not limited to pME2001, pMV15, and pMP1. The invention is not limited by the expression vector or host cell employed.

The "control elements" or "regulatory sequences" are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the BLUESCRIPT phagemid (Stratagene, LaJolla, Calif.) or pSPORT1 plasmid (Life Technologies) and the like may be used. The baculovirus polyhedrin promoter may be used in insect cells. Promoters or enhancers derived from the genomes of plant cells (e.g., heat shock, RUBISCO, and storage protein genes) or from plant viruses (e.g., viral promoters or leader sequences) may be cloned into the vector.

In bacterial systems, a number of expression vectors may be selected depending upon the use intended for the peptide or polypeptide. For example, when large quantities of peptide or polypeptide are needed, vectors which direct high level expression of fusion proteins that are readily purified may be used. Such vectors include, but are not limited to, the multifunctional *E. coli* cloning and expression vectors such as BLUESCRIPT (Stratagene), in which the sequence encoding a polypeptide may be ligated into the vector in frame with sequences for the amino-terminal Met and the subsequent 7 residues of β-galactosidase so that a hybrid protein is produced; pIN vectors (Van Heeke, G. and S. M. Schuster (1989) J. Biol. Chem. 264:5503-5509); and the like.

pGEX vectors (Promega, Madison, Wis.) may also be used to express peptides or polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor Xa protease cleavage sites so that the cloned peptide or polypeptide of interest can be released from the GST moiety at will. In the yeast, *Saccharomyces cerevisiae*, a number of vectors containing constitutive or inducible promoters such as alpha factor, alcohol oxidase, and PGH may be used. For reviews, see Ausubel et al. (supra) and Grant et al. (1987) Methods Enzymol. 153:516-544.

Specific initiation signals may also be used to achieve more efficient translation of sequences encoding the peptides or polypeptides of the invention. Such signals include the ATG initiation codon and adjacent sequences. In cases where sequences encoding a peptide or polypeptide, its initiation codon, and upstream sequences are inserted into the appropriate expression vector, no additional transcriptional or translational control signals may be needed. However, in cases where only coding sequence, or a fragment thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers which are appropriate for the particular cell system which is used, such as those described in the literature (Scharf, D. et al. (1994) Results Probl. Cell Differ. 20:125-162).

In addition, a host cell strain may be chosen for its ability to modulate the expression of the inserted sequences or to process the expressed peptide or polypeptide in the desired fashion. Such modifications of the sequence include, but are not limited to, acetylation, carboxylation, glycosylation, phosphorylation, lipidation, and acylation. Post-translational processing which cleaves a "prepro" form of the peptide or polypeptide may also be used to facilitate correct insertion, folding, and/or function. Different host cells which have specific cellular machinery and characteristic mechanisms for post-translational activities are available from the American Type Culture Collection (ATCC; 10801 University Boulevard, Manassas, Va. 20110-2209) and may be chosen to ensure the correct modification and processing of the sequence. Specific host cells include, but are not limited to, methanogen cells, such as *Methanobrevibacter* cells, in particular, *M. ruminantium*, or *M. smithii* cells. Host cells of interest include, for example, *Rhodotorula, Aureobasidium, Saccharomyces, Sporobolomyces, Pseudomonas, Erwinia* and *Flavobacterium*; or such other organisms as *Escherichia, Lactobacillus, Bacillus, Streptomyces*, and the like. Specific host cells include *Escherichia coli*, which is particularly suited for use with the present invention, *Saccharomyces cerevisiae, Bacillus thuringiensis, Bacillus subtilis, Streptomyces lividans*, and the like.

There are several techniques for introducing nucleic acids into eukaryotic cells cultured in vitro. These include chemical methods (Feigner et al., Proc. Natl. Acad. Sci., USA, 84:7413 7417 (1987); Bothwell et al., Methods for Cloning and Analysis of Eukaryotic Genes, Eds., Jones and Bartlett Publishers Inc., Boston, Mass. (1990), Ausubel et al., Short Protocols in Molecular Biology, John Wiley and Sons, New York, N.Y. (1992); and Farhood, Annal. NY Acad. Sci.; 716:23 34 (1994)), use of protoplasts (Bothwell, supra) or electrical pulses (Vatteroni et al., Mutn. Res., 291:163 169 (1993); Sabelnikov, Prog. Biophys. Mol. Biol., 62: 119 152 (1994); Bothwell et al., supra; and Ausubel et al., supra), use of attenuated viruses (Davis et al., J. Virol. 1996, 70(6), 3781 3787; Brinster et al. J. Gen. Virol. 2002, 83 (Pt 2), 369 381; Moss, Dev. Biol. Stan., 82:55 63 (1994); and Bothwell et al., supra), as well as physical methods (Fynan et al., Int J. Immunopharmacol. 1995 February; 17(2):79-83; Johnston et al., Meth. Cell Biol., 43 (Pt A):353 365 (1994); Bothwell et al., supra; and Ausubel et al., supra).

Successful delivery of nucleic acids to animal tissue can be achieved by cationic liposomes (Watanabe et al., Mol. Reprod. Dev., 38:268 274 (1994)), direct injection of naked DNA or RNA into animal muscle tissue (Robinson et al., Vacc., 11:957 960 (1993); Hoffman et al., Vacc. 12:1529 1533; (1994); Xiang et al., Virol., 199:132 140 (1994); Webster et al., Vacc., 12:1495 1498 (1994); Davis et al., Vacc., 12:1503 1509 (1994); Davis et al., Hum. Molec. Gen., 2:1847 1851 (1993); Dalemans et al. Ann NY Acad. Sci. 1995, 772, 255 256. Conry, et al. Cancer Res. 1995, 55(7), 1397-1400), and embryos (Naito et al., Mol. Reprod. Dev., 39:153 161 (1994); and Burdon et al., Mol. Reprod. Dev., 33:436 442 (1992)), intramuscular injection of self replicating RNA vaccines (Davis et al., J Virol 1996, 70(6), 3781 3787; Balasuriya et al. Vaccine 2002, 20 (11 12), 1609 1617) or intradermal injection of DNA using "gene gun" technology (Johnston et al., supra).

A variety of protocols for detecting and measuring the expression of the peptides or polypeptides of the invention, using either polyclonal or monoclonal antibodies specific for the protein are known in the art. Examples include enzyme-linked immunosorbent assay (ELISA), radioimmunoassay (RIA), and fluorescence activated cell sorting (FACS). A two-site, monoclonal-based immunoassay can be used with monoclonal antibodies reactive to two non-interfering epitopes on the peptide or polypeptide, but a competitive binding assay can also be used. These and other assays are described, among other places, in Hampton, R. et al. (1990; Serological Methods, a laboratory Manual, APS Press, St Paul, Minn.) and Maddox, D. E. et al. (1983; J. Exp. Med. 158:1211-1216).

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences encoding the peptides or polypeptides, or any fragments or variants thereof, may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits Amersham Pharmacia Biotech, Promega, and US Biochemical. Suitable reporter molecules or labels, which may be used for ease of detection, include radionuclides, enzymes, fluorescent, chemiluminescent, or chromogenic agents as well as substrates, cofactors, inhibitors, magnetic particles, and the like.

Expression vectors or host cells transformed with expression vectors may be cultured under conditions suitable for the expression and recovery of the peptide or polypeptide from culture. The culture can comprise components for in vitro or in vivo expression. In vitro expression components include those for rabbit reticulocyte lysates, *E. coli* lysates, and wheat germ extracts, for example, EXPRESSWAY™ or RiPs systems from Invitrogen, GENELATOR™ systems from iNtRON Biotechnology, ECOPRO™ or STP3™ systems from Novagen, TNT® QUICK COUPLED systems from Promega, and EASYXPRESS systems from QIAGEN. The peptide or polypeptide produced from culture may be secreted or contained intracellularly depending on the sequence and/or the vector used. In particular aspects, expression vectors which encode a peptide or polypeptide can be designed to contain signal sequences which direct secretion of the peptide or polypeptide through a prokaryotic or eukaryotic cell membrane.

Other constructions may include an amino acid domain which will facilitate purification of the peptide or polypeptide. Such domains include, but are not limited to, metal chelating domains such as histidine-tryptophan (e.g., 6×-HIS) modules that allow purification on immobilized metals, protein A domains that allow purification on immobilized immunoglobulin, and the domain utilized in the FLAG® extension/affinity purification system (Immunex Corp., Seattle, Wash.). Useful epitope tags include 3XFLAG®, HA, VSV-G, V5, HSV, GST, GFP, MBP, GAL4, and β-galactosidase. Useful plasmids include those comprising a biotin tag (e.g., PINPOINT™ plasmids from Promega), calmodulin binding protein (e.g., pCAL plasmids from Stratagene), streptavidin binding peptide (e.g., InterPlay™ plasmids from Stratagene), a c-myc or FLAG® tag (e.g., Immunoprecipitation plasmids from Sigma-Aldrich), or a histidine tag (e.g., QIAExpress plasmids from QIAGEN).

To facilitate purification, expression vectors can include cleavable linker sequences such as those specific for Factor Xa or enterokinase (Invitrogen, San Diego, Calif.). For example, the vector can include one or more linkers between the purification domain and the peptide or polypeptide. One such expression vector provides for expression of a fusion protein comprising a peptide or polypeptide of the invention and a nucleic acid encoding 6 histidine residues (SEQ ID NO: 1396) preceding a thioredoxin or an enterokinase cleavage site. The histidine residues facilitate purification on IMAC (immobilized metal ion affinity chromatography as described in Porath, J. et al. (1992) Prot. Exp. Purif. 3: 263-281) while the enterokinase cleavage site provides a means for purifying the peptide or polypeptide from the fusion protein. A discussion of vectors which contain fusion proteins is provided in Kroll, D. J. et al. (1993; DNA Cell Biol. 12:441-453).

Antibodies and Vaccines

The antibodies of the invention may be produced using methods which are generally known in the art. In particular, purified peptides, polypeptides, or polynucleotides may be used to produce antibodies in accordance with known methods. Such antibodies may include, but are not limited to, polyclonal, monoclonal, chimeric, and single chain antibodies, Fab fragments, and fragments produced by a Fab expression library. Neutralizing antibodies, (i.e., those which inhibit function) are especially preferred for use with vaccines.

For the production of antibodies, various hosts including goats, rabbits, rats, mice, humans, and others, may be immunized by injection with a peptide, polypeptide, polynucleotide, or any fragment thereof which has immunogenic properties. Depending on the host species, various adjuvants may be used to increase immunological response. Such adjuvants include, but are not limited to, Freund's, mineral gels such as aluminium hydroxide, and surface active substances such as lysolecithin, pluronic polyols, polyanions, peptides, oil emulsions, keyhole limpet hemocyanin, polyols, polyanions, peptides, oil emulsions, keyhole limpet hemocyanin, and dinitrophenol. Among adjuvants used in humans, BCG (bacilli Calmette-Guerin) and *Corynebacterium parvum* are especially preferable.

It is preferred that the peptides, polypeptides, or fragments used to induce antibodies have an amino acid sequence comprising at least five amino acids and more preferably at least 10 amino acids. It is also preferable that they are identical to a portion of the amino acid sequence of the natural protein, and they may contain the entire amino acid sequence of a small, naturally occurring molecule. Short stretches of amino acids may be fused with those of another protein such as keyhole limpet hemocyanin and antibody produced against the chimeric molecule.

Monoclonal antibodies may be prepared using any technique which provides for the production of antibody molecules by continuous cell lines in culture. These include, but are not limited to, the hybridoma technique, the human B-cell hybridoma technique, and the EBV-hybridoma technique (Kohler, G. et al. (1975) Nature 256:495-497; Kozbor, D. et al. (1985) J. Immunol. Methods 81:31-42; Cote, R. J. et al. (1983) Proc. Natl. Acad. Sci. 80:2026-2030; Cole, S. P. et al. (1984) Mol. Cell. Biol. 62:109-120).

In addition, techniques developed for the production of "chimeric antibodies", e.g., the combining of mouse antibody genes and human antibody genes to obtain a molecule with appropriate antigen specificity and biological activity can be used (Morrison, S. L. et al. (1984) Proc. Natl. Acad. Sci. 81:6851-6855; Neuberger, M. S. et al. (1984) Nature 312: 604-608; Takeda, S. et al. (1985) Nature 314:452-454). Alternatively, techniques described for the production of single chain antibodies may be adapted, using methods known in the art, to produce specific single chain antibodies. Antibodies with related specificity, but of distinct idiotypic composition, may be generated by chain shuffling from random combinatorial immunoglobin libraries (Burton D. R. (1991) Proc. Natl. Acad. Sci. 88:11120-3).

Those of skill in the art to which the invention relates will appreciate the terms "diabodies" and "triabodies". These are molecules which comprise a heavy chain variable domain (VH) connected to a light chain variable domain (VL) by a short peptide linker that is too short to allow pairing between the two domains on the same chain. This promotes pairing with the complementary domains of one or more other chains and encourages the formation of dimeric or trimeric molecules with two or more functional antigen binding sites. The resulting antibody molecules may be monospecific or multispecific (e.g., bispecific in the case of diabodies). Such antibody molecules may be created from two or more antibodies using methodology standard in the art to which the invention relates; for example, as described by Todorovska et al. (Design and application of diabodies, triabodies and tetrabodies for cancer targeting. J. Immunol. Methods. 2001 Feb. 1; 248 (1-2):47-66).

Antibodies may also be produced by inducing in vivo production in the lymphocyte population or by screening immunoglobulin libraries or panels of highly specific binding reagents as disclosed in the literature (Orlandi, R. et al. (1989) Proc. Natl. Acad. Sci. 86:3833-3837; Winter, G. et al. (1991) Nature 349:293-299).

Antibody fragments which contain specific binding sites may also be generated. For example, such fragments include, but are not limited to, the F(ab')$_2$ fragments which can be produced by pepsin digestion of the antibody molecule and the Fab fragments which can be generated by reducing the disulfide bridges of the F(ab')$_2$ fragments. Alternatively, Fab expression libraries may be constructed to allow rapid and easy identification of monoclonal Fab fragments with the desired specificity (Huse, W. D. et al. (1989) Science 254: 1275-1281).

Various immunoassays may be used for screening to identify antibodies having binding specificity. Numerous protocols for competitive binding or immunoradiometric assays using either polyclonal or monoclonal antibodies with established specificities are well known in the art. Such immunoassays typically involve the measurement of complex formation between a peptide, polypeptide, or polynucleotide and its specific antibody. A two-site, monoclonal-based immunoassay utilizing monoclonal antibodies reactive to two non-interfering epitopes is preferred, but a competitive binding assay may also be employed (Maddox, supra).

The antibodies described herein have the ability to target and/or inhibit cells and are also useful as carrier molecules for the delivery of additional inhibitory molecules into microbial cells. The chemistry for coupling compounds to amino acids is well developed and a number of different molecule types could be linked to the antibodies. The most common coupling methods rely on the presence of free amino (alpha-amino or Lys), sufhydryl (Cys), or carboxylic acid groups (Asp, Glu, or alpha-carboxyl). Coupling methods can be used to link the antibody to the cell inhibitor via the carboxy- or amino-terminal residue. In some cases, a sequence includes multiple residues that may react with the chosen chemistry. This can be used to produce multimers, comprising more than one cell inhibitor. Alternatively, the antibody can be shortened or chosen so that reactive residues are localized at either the amino or the carboxyl terminus of the sequence.

For example, a reporter molecule such as fluorescein can be specifically incorporated at a lysine residue (Ono et al., 1997) using N-α-Fmoc-Nε-1-(4,4-dimethyl-2,6 dioxocyclohex-1-ylidene-3-methylbutyl)-L-lysine during polypeptide synthesis. Following synthesis, 5- and 6-carboxyfluorescein succinimidyl esters can be coupled after 4,4-dimethyl-2,6 dioxocyclohex-1-ylidene is removed by treatment with hydrazine. Therefore coupling of an inhibitory molecule to the antibody can be accomplished by inclusion of a lysine residue to the polypeptide sequence, then reaction with a suitably derivatised cell inhibitor.

EDC (1-ethyl-3-(3-dimethylaminopropyl) carbodiimide hydrochloride) or the carbodiimide coupling method can also be used. Carbodiimides can activate the side chain carboxylic groups of aspartic and glutamic acid as well as the carboxyl-terminal group to make them reactive sites for coupling with primary amines. The activated antibody is mixed with the cell inhibitor to produce the final conjugate. If the cell inhibitor is activated first, the EDC method will couple the cell inhibitor through the N-terminal alpha amine and possibly through the amine in the side-chain of Lys, if present in the sequence.

m-Maleimidobenzoyl-N-hydroxysuccinimide ester (MBS) is a heterobifunctional reagent that can be used to link an antibody to cell inhibitors via cysteines. The coupling takes place with, the thiol group of cysteine residues. If the chosen sequence does not contain Cys it is common to place a Cys residue at the N- or C-terminus to obtain highly controlled linking of the antibody to the cell inhibitor. For synthesis purposes, it may be helpful for the cysteine to be placed at the N-terminus of the antibody: MBS is particularly suited for use with the present invention.

Glutaraldehyde can be used as a bifunctional coupling reagent that links two compounds through their amino groups. Glutaraldehyde provides a highly flexible spacer between the antibody and cell inhibitor for favorable presentation. Glutaraldehyde is a very reactive compound and will react with Cys, Tyr, and His to a limited extent. The glutaraldehyde coupling method is particularly useful when a polypeptide contains only a single free amino group at its amino terminus. If the antibody contains more than one free amino group, large multimeric complexes can be formed.

In one aspect, the antibodies of the invention can be fused (e.g., by in-frame cloning) or linked (e.g., by chemical coupling) to cell inhibitors such as antimicrobial agents. Included among these are antimicrobial peptides, for example, bactericidal/permeability-increasing protein, cationic antimicrobial proteins, lysozymes, lactoferrins, and cathelicidins (e.g., from neutrophils; see, e.g., Hancock and Chapple, 1999, Antimicrob. Agents Chemother. 43:1317-1323; Ganz and Lehrer, 1997, Curr. Opin. Hematol. 4:53-58; Hancock et al., 1995, Adv. Microb. Physiol. 37:135-175). Antimicrobial peptides further include defensins (e.g., from epithelial cells or neutrophils) and platelet microbiocidal proteins (see, e.g., Hancock and Chapple, 1999, Antimicrob. Agents Chemother. 43:1317-1323). Additional antimicrobial peptides include, but are not limited to, gramicidin S, bacitracin, polymyxin B, tachyplesin, bactenecin (e.g., cattle bactenecin), ranalexin, cecropin A, indolicidin (e.g., cattle indolicidin), and nisin (e.g., bacterial nisin).

Also included as antimicrobial agents are ionophores, which facilitate transmission of an ion, (such as sodium), across a lipid barrier such as a cell membrane. Two ionophore compounds particularly suited to this invention are the RUMENSIN™ (Eli Lilly) and Lasalocid (Hoffman LaRoche). Other ionophores include, but are not limited to, salinomycin, avoparcin, aridcin, and actaplanin. Other antimicrobial agents include Monensin™ and azithromycin, metronidazole, streptomycin, kanamycin, and penicillin, as well as, generally, β-lactams, aminoglycosides, macrolides, chloramphenicol, novobiocin, rifampin, and fluoroquinolones (see, e.g., Horn et al., 2003, Applied Environ. Microbiol. 69:74-83; Eckburg et al., 2003, Infection Immunity 71:591-596; Gijzen et al., 1991, Applied Environ. Microbiol. 57:1630-1634; Bonelo et al., 1984, FEMS Microbiol. Lett. 21:341-345; Huser et al., 1982, Arch. Microbiol. 132:1-9; Hilpert et al., 1981, Zentbl. Bakteriol. Mikrobiol. Hyg. 1 Abt Orig. C 2:21-31).

Particularly useful inhibitors are compounds that block or interfere with methanogenesis, including bromoethanesulphonic acid, e.g., 2-bromoethanesulphonic acid (BES) or a salt thereof, for example, a sodium salt. Sodium molybdate (Mo) is an inhibitor of sulfate reduction, and can be used with bromoethanesulphonic acid. Other anti-methanogenesis compounds include, but are not limited to, nitrate, formate, methyl fluoride, chloroform, chloral hydrate, sodium sulphite, ethylene and unsaturated hydrocarbons, acetylene, fatty acids such as linoleic and cis-oleic acid, saturated fatty acids such as behenic and stearic acid, and, also lumazine (e.g., 2,4-pteridinedione). Additional compounds include 3-bromopropanesulphonate (BPS), propynoic acid, and ethyl 2-butynoate.

Further included as antimicrobial agents are lytic enzymes, including phage lysozyme, endolysin, lysozyme, lysin, phage lysin, muralysin, muramidase, and virolysin. Useful enzymes exhibit the ability to hydrolyse specific bonds in the bacterial cell wall. Particular lytic enzymes include, but are not limited to, glucosaminidases, which hydrolyse the glycosidic bonds between the amino sugars (e.g., N-acetylmuramic acid and N-acetylglucosamine) of the peptidoglycan, amidases, which cleave the N-acetylmuramoyl-L-alanine amide linkage between the glycan strand and the cross-linking peptide, and endopeptidases, which hydrolyse the interpeptide linkage (e.g., cysteine endopeptidases) and endoisopeptidases that attack pseudomurein of methanogens from the family *Methanobacteriaceae*.

Additionally, PNAs are included as antimicrobial agents. PNAs are peptide-nucleic acid hybrids in which the phosphate backbone has been replaced by an achiral and neutral backbone made from N-(2-aminoethyl)-glycine units (see, e.g., Eurekah Bioscience Collection. PNA and Oligonucleotide Inhibitors of Human Telomerase. G. Gavory and S. Balasubramanian, Landes Bioscience, 2003). The bases A, G, T, C are attached to the amino nitrogen on the backbone via methylenecarbonyl linkages (P. E. Nielsen et al., Science 1991. 254: 1497-1500; M. Egholm et al., Nature 1993. 365: 566-568). PNAs bind complementary sequences with high specificity, and higher affinity relative to analogous DNA or RNA (M. Egholm et al., supra). PNA/DNA or PNA/RNA hybrids also exhibit higher thermal stability compared to the corresponding DNA/DNA or DNA/RNA duplexes (M. Egholm et al., supra). PNAs also possess high chemical and biological stability, due to the unnatural amide backbone that is not recognized by nucleases or proteases (V. Demidov et al., Biochem Pharmacol 1994. 48: 1310-1313). Typically, PNAs are at least 5 bases in length, and include a terminal lysine. PNAs may be pegylated to further extend their lifespan (Nielsen, P. E. et al. (1993) Anticancer Drug Des. 8:53-63).

In one particular aspect, the antibodies of the invention can be fused or linked to other antibodies or fragments thereof. The added antibodies or antibody fragments can be directed to microbial cells, or particularly methanogen cells, or one or more cell components. For example, cell surface proteins, e.g., extracellular receptors, can be targeted. In certain aspects, the antibodies or antibody fragments can be engineered with sequences that are specifically expressed in subjects, for example, human or ruminant sequences. Also included are chimeric antibodies, for example, monoclonal antibodies or fragments thereof that are specific to more than one source, e.g., one or more mouse, human, or ruminant sequences. Further included are camelid antibodies or nanobodies.

The antibodies of the invention find particular use in targeting a microbial cell, in particular, a methanogen cell. In certain aspects, the antibodies can be used to associate with or bind to the cell wall or membrane and/or inhibit growth or replication of the cell. As such, the antibodies can be used for transient or extended attachment to the cell, or to mediate sequestration or engulfment of the cell, and/or lysis. To effect targeting, the microbial cell can be contacted with an antibody as isolated from a host organism, or produced by expression vectors and/or host cells, or synthetic or semi-synthetic chemistry as described in detail herein. Alternately, the antibodies can be produced by the host organism itself in response to the administration or the peptides, polypeptides, or polynucleotides disclosed herein. It is understood that the antibodies of the invention, as well as the corresponding polynucleotides, expression vectors, host cells, peptides, and polypeptides, can be used to target various microbes, for example, *Methanobrevibacter ruminantium*, which is the primary methanogen in ruminants, and *Methanobrevibacter smithii*, which is the primary methanogen in humans. In particular aspects, the antibodies, or corresponding polynucleotides, expression vectors, host cells, peptides, or polypeptides, are delivered to subjects as a composition described in detail herein, for example, through use of a slow-release ruminal device.

In various aspects, the agents of the invention (e.g., one or more peptides, polypeptides, polynucleotides, and antibodies) can be included in a composition, for example, a pharmaceutical composition, and especially a vaccine composition. The composition comprises, for example: a) an isolated peptide or alteration, fragment, variant, or derivative thereof; b) an isolated polypeptide, or an alteration, fragment, variant, or derivative thereof; c) an isolated polynucleotide, or an alteration, fragment, variant, or derivative thereof; d) an expression vector comprising this polynucleotide; e) a host cell comprising this expression vector; or (f) an antibody, or an alteration, fragment, variant, or derivative thereof. The compositions of the invention can be specifically packaged as part of kits for targeting, and/or inhibiting microbial cells, especially methanogen cells, in accordance with the disclosed methods. The kits comprise at least one composition as set out herein and instructions for use in targeting cells or inhibiting cell growth or replication, for methanogens or other microbes.

For vaccines, a number of approaches can be used to increase antigen immunogenicity, for example, by use of antigen particles; antigen polymers and polymerization; emulsifying agents; microencapsulation of antigens; killed bacteria and bacterial products; chemical adjuvants and cytokines; and agents for targeting antigens to antigen presenting cells (reviewed in Paul, Fundamental Immunology, 1999, Lippincott-Raven Publishers, New York, N.Y., p. 1392-1405).

To render antigens particulate, alum precipitation can be used. With the use of aluminium hydroxide or aluminium phosphate, the antigen in question becomes incorporated into an insoluble, gel-like precipitate or else is bound to preformed gel by electrostatic interactions. Antigens can be subjected to mild heat aggregation. Antigens exhibiting self-assembly can also be used. Liposomes, virosomes, and immunostaining complexes (ISCOMs) are also useful for forming particulates.

To promote polymerization, nonionic block copolymers can be used as additives to adjuvants, e.g., polymers or polyoxypropylene and polyoxyethylene, with which antigen can be associated. These are found as components of complex adjuvant formulations by both Syntex (SAF-1, Syntex Adjuvant Formulation-1) and Ribi Chemical Co. Carbohydrate polymers of mannose (e.g., mannan) or of β1-3 glucose (e.g., glucan) can be used in similar fashion (Okawa Y, Howard C R, Steward M W. Production of anti-peptide antibody in mice following immunization of mice with peptides conjugated to mannan. J Immunol Methods 1992; 142:127-131; Ohta M, Kido N, Hasegawa T, et al. Contribution of the mannan side chains to the adjuvant action of lipopolysaccharides. Immunology 1987; 60:503-507).

Various agents can be used for emulsification, including water-in-oil emulsions, such as Freund's adjuvants (e.g., Freund's incomplete adjuvant), or other mixtures comprising tiny droplets of water stabilized by a surfactant such as mannide monooleate in a continuous phase of mineral oil or other oils, such as squalane. An alternative approach is to use oil-in-water emulsions, such as MF5963 (Chiron), or other mixtures comprising oil droplets of squalene and a mixture of emulsifying agents TWEEN80 and SPAN85, and chemical immunomodulators such as derivatives or muramyl dipeptide, e.g., muramyl tripeptide-phosphatidyl ethanolamine (MTP-PE) (Valensi J-P M, Carlson J R, Van Nest G A. Systemic cytokine profiles in Balb/c mice immunized with trivalent influenza vaccine containing MF59 oil emulsion and other advanced adjuvants. J Immunol 1994; 153:4029-4039). Small amounts of polysorbate 80 and sorbitan trioleate can also be used in the mixtures. As another example, SAF-165 (Syntex) can be used, or other oil-in-water mixtures comprising Pluronic L121, squalene, and TWEEN80.

Microcapsules, in particular, biodegradable microcapsules, can be used to prepare controlled-release vaccines (Chang T M S. Biodegradable, semi-permeable microcapsules containing enzymes hormones, vaccines and other biologicals. J Bioeng 1976; 1:25-32; Langer R. Polymers for the sustained release of macromolecules: their use in a single step method of immunization. Methods Enzymol 1981; 73:57-75). Cyanoacrylates are another form of biodegradable polymer. For example, poly(butyl-2-cyanoacrylate) can be used as an adjuvant for oral immunization (O'Hagan D T, Palin K J, Davis S S. Poly(butyl-2-cyanoacrylate) particles as adjuvants for oral immunization. Vaccine 1989; 7:213-216). Microcapsules are useful for the mucosal administration of vaccines. Particles of very small size (nanoparticles) are particularly suitable. Digestion in the stomach can be countered by enteric coated polymers, and coating with substances that increase intestinal absorption, as needed.

Various bacteria, other than killed *M. tuberculosis*, can be used as adjuvants. Where the killed bacterial preparation is itself highly antigenic, the adjuvant properties extend to the co-administered antigen. Useful organisms include *Bordetella pertussis, Corynebacterium parvum*, and *Nippostrongylus brasiliensis*. Peptide and lipid components of bacteria can also be used. Exemplary components include acetylmuramyl-L-alanyl-D-isoglutamine, or muramyl dipeptide (MDP) (Ellouz F, Adam A, Ciorbaru R, Lederer E. Minimal structural requirements for adjuvant activity of bacterial peptidoglycans. Biochem Biophys Res Commun 1974; 59:1317-1325), MDP (murabutide) (Chedid L, Parant M A, Audibert F M, et al. Biological activity of a new synthetic muramyl dipeptide devoid of pyrogenicity. Infect Immun 1982; 35:417-424), threonyl MDP (Allison A C, Byars N E. An adjuvant formulation that selectively elicits the formation of antibodies of protective isotypes and cell-mediated immunity. J Immunol Methods 1986; 95:157-168), and MTP-PE. Lipid adjuvants can comprise LPS endotoxins of gram-negative bacteria, such as *Escherichia, Salmonella*, and *Pseudomonas*. In certain approaches, the lipid A structure can be chemically modified to lower toxicity but retain adjuvanticity, e.g., as for monophosphoryl lipid A (MPL) (Johnson A G, Tomai M, Solem L, Beck L, Ribi E. Characterization of non-toxic monophosphoryl lipid. Rev Infect Dis 1987; 9:S512).

Various chemicals can be used as adjuvants, including polynucleotides, such as poly-I:C and poly-A:U, vitamin D3, dextran sulphate, inulin, dimethyl dioctadecyl ammonium bromide (DDA), pyridine, carbohydrate polymers similar to mannan, and trehalose dimycolate (Morein B, Lovgren-Bengtsson K, Cox J. Modern adjuvants: functional aspects. In: Kaufmann S H E, ed. Concepts in vaccine development. Berlin: Walter de Gruyter, 1996:243-263). Also included are polyphosphazines (initially introduced as slow release-promoting agents) and a *Leishmania* protein, LeIF. Cytokines can also be used as adjuvants, for example, IL-2, IL-4, IL-6, IL-10, GM-CSF, and IFN-g.

For targeting antigen presenting cells, C3d domains, Fc domains, and CTB domains can be used (Dempsey P W, Allison M E D, Akkaraju S, Goodnow C C, Fearon D T. C3d of complement as a molecular adjuvant: bridging innate and acquired immunity. Science 1996; 271:348-350; Sun J-B, Holmgren J, Czerkinsky C. Cholera toxin B subunit: an efficient transmucosal carrier-delivery system for induction of peripheral immunological tolerance. Proc Natl Acad Sci USA 1994; 91:10795-10799; Sun J-B, Rask C, Olsson T, Holmgren J, Czerkinsky C. Treatment of experimental autoimmune encephalomyelitis by feeding myelin basic protein conjugated to cholera toxin B subunit. Proc Natl Acad Sci USA 1996; 93:7196-7201).

Specific adjuvants for mucosal delivery, e.g., CT, LT, and Fragment C of tetanus toxin, can also be used (Elson C J, Ealding W. Generalized systemic and mucosal immunity in mice after mucosal stimulation with cholera toxin. J Immunol 1984; 132:2736-2743; Holmgren J, Lycke N, Czerkinsky C. Cholera toxin and cholera B subunit as oral-mucosal adjuvant and antigen vector systems. Vaccine 1993; 11:1179-1184; Clements J D, Hartzog N M, Lyon F L. Adjuvant activity of *Escherichia coli* heat-labile enterotoxin and effect on the induction of oral tolerance in mice to unrelated protein antigens.

Vaccine. 1988; 6:269-277; Gomez-Duarte O G, Galen J, Chatfield S N, Rappuoli R, Eidels L, Levine M M. Expression of fragment C of tetanus toxin fused to a carboxyl-terminal fragment of diphtheria toxin in *Salmonella typhi* CVD 908 vaccine strain. Vaccine 1995; 13:1596-1602).

Therapeutics and Diagnostics

The peptides, polypeptides, polynucleotides, and antibodies of the present invention are considered to have health benefits. In particular aspects, vaccines that target methanogens can be used to restore energy to the subject that is normally lost as methane. The invention therefore relates to a pharmaceutical composition (especially a vaccine composition) in conjunction with a pharmaceutically acceptable carrier, for use with any of the methods discussed above. Such pharmaceutical compositions may comprise a peptide, polypeptide, or antibody in combination with a cell inhibitor. Alternatively, the pharmaceutical compositions may comprise a polynucleotide, expression vector, or host cell as described in detail herein. The compositions may be administered alone or in combination with at least one other agent, such as stabilizing compound, which may be administered in any sterile, biocompatible pharmaceutical carrier, including, but not limited to, saline, buffered saline, dextrose, and water. The compositions may be administered to a subject alone, or in combination with other agents, drugs (e.g., antimicrobial drugs), or hormones.

In addition to the active ingredients, these pharmaceutical compositions may contain suitable pharmaceutically acceptable carriers comprising excipients and auxiliaries which facilitate processing of the active compounds into preparations which can be used pharmaceutically. Further details on techniques for formulation and administration may be found in the latest edition of Remington's Pharmaceutical Sciences (Maack Publishing Co., Easton, Pa.). The pharmaceutical compositions utilized in this invention may be administered by any number of routes including, but not limited to, oral, intravenous, intramuscular, intra-arterial, intramedullary, intrathecal, intraventricular, transdermal, subcutaneous, intraperitoneal, intranasal, enteral, topical, sublingual, or rectal means.

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions, and the like, for ingestion by the subject. Pharmaceutical preparations for oral use can be obtained through combination of active compounds with solid excipient, optionally grinding a resulting mixture, and processing the mixture of granules, after adding suitable auxiliaries, if desired, to obtain tablets or dragee cores. Suitable excipients are carbohydrate or protein fillers, such as sugars, including lactose, sucrose, mannitol, or sorbitol; starch from corn, wheat, rice, potato, or other plants; cellulose, such as methyl cellulose, hydroxypropylmethyl-cellulose, or sodium carboxymethylcellulose; gums including arabic and tragacanth; and proteins such as gelatin and collagen. If desired, disintegrating or solubilising agents may be added, such as the crosslinked polyvinyl pyrrolidone, agar, alginic acid, or a salt thereof, such as sodium alginate.

Pharmaceutical preparations which can be used orally include push-fit capsules made of gelatin, as well as soft, sealed capsules made of gelatin and a coating, such as glycerol or sorbitol. Push-fit capsules can contain active ingredients mixed with a filler or binders, such as lactose or starches, lubricants, such as talc or magnesium stearate, and, optionally, stabilizers. In soft capsules, the active compounds may be dissolved or suspended in suitable liquids, such as fatty oils, liquid, or liquid polyethylene glycol with or without stabilizers. Dragee cores may be used in conjunction with suitable coatings, such as concentrated sugar solutions, which may also contain gum arabic, talc, polyvinylpyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound, i.e., dosage.

Pharmaceutical formulations suitable for parenteral administration may be formulated in aqueous solutions, preferably in physiologically compatible buffers such as Hanks' solution, Ringer's solution, or physiologically buffered saline. Aqueous injection suspensions may contain substances which increase the viscosity of the suspension, such as sodium carboxymethyl cellulose, sorbitol, or dextran. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Non-lipid polycationic amino polymers may also be used for delivery. Optionally, the suspension may also contain suitable stabilizers or agents which increase the solubility of the compounds to allow for the preparation of highly concentrated solutions. For topical or nasal administration, penetrants appropriate to the particular barrier to be permeated are used in the formulation. Such penetrants are generally known in the art.

The pharmaceutical compositions of the present invention may be manufactured in a manner that is known in the art, e.g., by means of conventional mixing, dissolving, granulating, dragee-making, levigating, emulsifying, encapsulating, entrapping, or lyophilizing processes. The pharmaceutical composition may be provided as a salt and can be formed with many acids, including but not limited to, hydrochloric, sulfuric, acetic, lactic, tartaric, malic, succinic, etc. Salts tend to be more soluble in aqueous or other protonic solvents than are the corresponding free base forms. In other cases, the preferred preparation may be a lyophilized powder which may contain any or all of the following: 1-50 mM histidine, 0.1%-2% sucrose, and 2-7% mannitol, at a pH range of 4.5 to 5.5, that is combined with buffer prior to use. After pharmaceutical compositions have been prepared, they can be placed in an appropriate container and labeled for treatment of an indicated condition. For administration of a composition of the invention, such labeling would include amount, frequency, and method of administration.

Pharmaceutical compositions suitable for use in the invention include compositions wherein the active ingredients are contained in an effective amount to achieve the intended purpose. For any compound, the therapeutically effective dose can be estimated initially either in cell assays, e.g., in microbial cells, or in particular, in methanogen cells, or in animal models, usually mice, rabbits, dogs, or pigs, or in ruminant species such as sheep, cattle, deer, and goats. The animal model may also be used to determine the appropriate concentration range and route of administration. Such information can then be used to determine useful doses and routes for administration. Normal dosage amounts may vary from 0.1 to 100,000 micrograms, up to a total dose of about 1 g, depending upon the route of administration. Guidance as to particular dosages and methods of delivery is provided in the literature and generally available to practitioners in the art. Those skilled in the art will employ different formulations for polynucleotides than for polypeptides. Similarly, delivery of peptides, or polypeptides, polynucleotides, or antibodies will be specific to particular cells, conditions, locations, etc.

The exact dosage will be determined by the practitioner, in light of factors related to the subject that requires treatment. Dosage and administration are adjusted to provide sufficient levels of the active agent or to maintain the desired effect. Factors which may be taken into account include the severity of the disease state, general health of the subject, age, weight, and gender, diet, time, and frequency of administration, drug combination(s), reaction sensitivities, and tolerance/response to therapy. Long-acting pharmaceutical compositions may be administered every 3 to 4 days, every week, or once every two weeks depending on half-life and clearance rate of the particular formulation. The compositions can be co-administered with one or more additional anti-microbial agents, including anti-methanogenesis compounds (e.g., bromoethanesulphonic acid), antibodies and antibody fragments, lytic enzymes, peptide nucleic acids, antimicrobial peptides, and other antibiotics as described in detail herein. Co-administration can be simultaneous or sequential, or can alternate with repeated administration.

Particularly useful for the compositions of the invention (e.g., pharmaceutical compositions) are slow release formulas or mechanisms. For example, intra-ruminal devices include, but are not limited to, Time Capsule™ Bolus range by Agri-Feeds Ltd., New Zealand, originally developed within AgResearch Ltd., New Zealand, as disclosed in WO 95/19763 and NZ 278977, and CAPTEC by Nufarm Health & Sciences, a division of Nufarm Ltd., Auckland, New Zealand, as disclosed in AU 35908178, PCT/AU81/100082, and Laby et al., 1984, *Can. J. Anim. Sci.* 64 (Suppl.), 337-8, all of which are incorporated by reference herein. As a particular example, the device can include a spring and plunger which force the composition against a hole in the end of a barrel.

As a further embodiment, the invention relates to a composition for a water supplement, e.g., drenching composition, or food supplement, e.g., ruminant feed component, for use with any of the methods discussed above. In particular aspects, the food supplement comprises at least one vegetable material that is edible, and a peptide or polypeptide of the invention. Alternatively, the food supplement comprises at least one vegetable material that is edible, and a polypeptide or peptide, or, a polynucleotide encoding a peptide or polypeptide disclosed herein, for example, as an expression vector or host cell comprising the expression vector. In particular, the composition further includes a cell inhibitor, as fused or linked to the resultant sequence. The preferred vegetable material include any one of hay, grass, grain, or meal, for example, legume hay, grass hay, corn silage, grass silage, legume silage, corn grain, oats, barley, distillers grain, brewers grain, soy bean meal, and cotton seed meal. In particular, grass silage is useful as a food composition for ruminants. The plant material can be genetically modified to contain one or more components of the invention, e.g., one or more polypeptides or peptides, polynucleotides, or vectors.

In another embodiment, antibodies which specifically bind the peptides, polypeptides, or polynucleotides of the invention may be used to determine the presence of microbes, especially methanogens, or in assays to monitor levels of such microbes. The antibodies useful for diagnostic purposes may be prepared in the same manner as those described above. Diagnostic assays include methods which utilize the antibody and a label to detect a peptide or polypeptide in human body fluids or extracts of cells or tissues. The antibodies may be used with or without modification, and may be labeled by joining them, either covalently or non-covalently, with a reporter molecule. A wide variety of reporter molecules which are known in the art may be used, several of which are described above.

A variety of protocols for measuring levels of a peptide, polypeptide, or polynucleotide are known in the art (e.g., ELISA, RIA, and FACS), and provide a basis for diagnosing the presence or levels of a microbe, especially a methanogen. Normal or standard levels established by combining body fluids or cell extracts taken from normal subjects, e.g., normal humans or ruminants, with the antibody under conditions suitable for complex formation. The amount of standard complex formation may be quantified by various methods, but preferably by photometric means. Quantities of peptide, polypeptide, or polynucleotide expressed in subject, control, and treated samples (e.g., samples from vaccinated subjects) are compared with the standard values. Deviation between standard and subject values establishes the parameters for determining the presence or levels of the microbe.

In another embodiment of the invention, the polynucleotides may be used for diagnostic purposes using particular hybridization and/or amplification techniques. The polynucleotides which may be used include oligonucleotides, complementary RNA and DNA molecules, and PNAs. The polynucleotides may be used to detect and quantitate gene expression in samples in which expression may be correlated with the presence or levels of a microbe. The diagnostic assay may be used to distinguish between the absence, presence, and alteration of microbe levels, and to monitor levels during therapeutic intervention.

In one aspect, hybridization with PCR probes may be used to identify nucleic acid sequences, especially genomic sequences, which encode the peptides or polypeptides of the invention. The specificity of the probe, whether it is made from a highly specific region, e.g., 10 unique nucleotides in the 5' regulatory region, or a less specific region, e.g., in the 3' coding region, and the stringency of the hybridization or amplification (maximal, high, intermediate, or low) will determine whether the probe identifies only naturally occurring sequences, alleles, or related sequences. Probes may also be used for the detection of related sequences, and should preferably contain at least 50% of the nucleotides from any of the coding sequences. The hybridization probes of the subject invention may be DNA or RNA and derived from the nucleotide sequence of SEQ ID NO:703-1395, or complements, or modified sequences thereof, or from genomic sequences including promoter and enhancer elements of the naturally occurring sequence.

Means for producing specific hybridization probes for DNAs include the cloning of nucleic acid sequences into vectors for the production of mRNA probes. Such vectors are known in the art, commercially available, and may be used to synthesize RNA probes in vitro by means of the addition of the appropriate RNA polymerases and the appropriate labeled nucleotides. Hybridization probes may be labeled by a variety of reporter groups, for example, radionuclides such as $^{32}P$ or $^{35}S$, or enzymatic labels, such as alkaline phosphatase coupled to the probe via avidin/biotin coupling systems, and the like. The polynucleotides may be used in Southern or northern analysis, dot blot, or other membrane-based technologies; in PCR technologies; or in dipstick, pin, ELISA assays, or microarrays utilizing fluids or tissues from subject biopsies to detect the presence or levels of a microbe. Such qualitative or quantitative methods are well known in the art.

In a particular aspect, the nucleic acid sequences may be useful in various assays labelled by standard methods, and added to a fluid or tissue sample from a subject under conditions suitable for hybridization and/or amplification. After a suitable incubation period, the sample is washed and the signal is quantitated and compared with a standard value. If the amount of signal in the test sample is significantly altered from that of a comparable control sample, the presence of altered levels of nucleotide sequences in the sample indicates the presence or levels of the microbe. Such assays may also be used to evaluate the efficacy of a particular vaccination regimen in animal studies, In clinical trials, or in monitoring the treatment of a subject.

In order to provide a basis for the diagnosis of the presence or levels of a microbe, a normal or standard profile for expression is established. This may be accomplished by combining body fluids or cell extracts taken from normal subjects, with a polynucleotide or a fragment thereof, under conditions suitable for hybridization and/or amplification. Standard levels may be quantified by comparing the values obtained from normal subjects with those from an experiment where a known amount of a substantially purified polynucleotide is used. Standard values obtained from normal samples may be compared with values obtained from samples from subjects treated for microbial growth. Deviation between standard and subject values is used to establish the presence or levels of the microbe.

Once the microbe is identified and a vaccination protocol is initiated, hybridization and/or amplification assays may be repeated on a regular basis to evaluate whether the level of expression in the subject begins to decrease relative to that which is observed in the normal subject. The results obtained from successive assays may be used to show the efficacy of vaccination over a period ranging from several days to months.

Particular diagnostic uses for oligonucleotides designed from the nucleic acid sequences may involve the use of PCR. Such oligomers may be chemically synthesized, generated enzymatically, or produced in vitro. Oligomers will preferably consist of two nucleotide sequences, one with sense orientation (5'.fwdarw.3') and another with antisense orientation (3'.fwdarw.5'), employed under optimized conditions for identification of a specific gene or condition. The same two oligomers, nested sets of oligomers, or even a degenerate pool of oligomers may be employed under less stringent conditions for detection and/or quantitation of closely related DNA or RNA sequences.

Methods which may also be used to quantitate expression include radiolabeling or biotinylating nucleotides, coamplification of a control nucleic acid, and standard curves onto which the experimental results are interpolated (Melby, P. C. et al. (1993) J. Immunol. Methods, 159:235-244; Duplaa, C. et al. (1993) Anal. Biochem. 229-236). The speed of quantitation of multiple samples may be accelerated by running the assay in an ELISA format where the oligomer of interest is presented in various dilutions and a spectrophotometric or colorimetric response gives rapid quantitation.

In further embodiments, oligonucleotides or longer fragments derived from any of the polynucleotides described herein may be used as targets in a microarray. The microarray can be used to monitor the expression level of large numbers of genes simultaneously (to produce a transcript image), and to identify genetic variants, mutations and polymorphisms. This information may be used to determine gene function, to understand the genetic basis of disease, to diagnose disease, and to develop and monitor the activities of therapeutic agents. In one embodiment, the microarray is prepared and used according to methods known in the art such as those described in PCT application WO95/11995 (Chee et al.), Lockhart, D. J. et al. (1996; Nat. Biotech. 14: 1675-1680) and Schena, M. et al. (1996; Proc. Natl. Acad. Sci. 93: 10614-10619).

In one aspect, the oligonucleotides may be synthesized on the surface of the microarray using a chemical coupling procedure and an ink jet application apparatus, such as that described in PCT application WO 95/251116 (Baldeschweiler et al.). In another aspect, a "gridded" array analogous to a dot or slot blot (HYBRIDOT apparatus, Life Technologies) may be used to arrange and link cDNA fragments or oligonucleotides to the surface of a substrate using a vacuum system, thermal, UV, mechanical or chemical bonding procedures. In yet another aspect, an array may be produced by hand or by using available devices, materials, and machines (including multichannel pipettors or robotic instruments; Brinkmann, Westbury, N.Y.) and may include, for example, 24, 48, 96, 384, 1024, 1536, or 6144 spots or wells (e.g., as a multiwell plate), or more, or any other multiple from 2 to 1,000,000 which lends itself to the efficient use of commercially available instrumentation.

In order to conduct sample analysis using the microarrays, polynucleotides are extracted from a biological sample. The biological samples may be obtained from any bodily fluid (blood, urine, saliva, phlegm, gastric juices, etc.), cultured cells, biopsies, or other tissue preparations. To produce probes, the polynucleotides extracted from the sample are used to produce nucleic acid sequences which are complementary to the nucleic acids on the microarray. If the microarray consists of cDNAs, antisense RNAs are appropriate probes. Therefore, in one aspect, mRNA is used to produce cDNA which, in turn and in the presence of fluorescent nucleotides, is used to produce fragments or antisense RNA probes. These fluorescently labeled probes are incubated with the microarray so that the probe sequences hybridize to the cDNA oligonucleotides of the microarray. In another aspect, nucleic acid sequences used as probes can include polynucleotides, fragments, and complementary or antisense sequences produced using restriction enzymes, PCR technologies, and oligolabeling kits (Amersham Pharmacia Biotech) well known in the area of hybridization technology.

In another embodiment of the invention, the peptides or polypeptides of the invention or functional or immunogenic fragments or oligopeptides thereof, can be used for screening libraries of compounds in any of a variety of drug screening techniques. The fragment employed in such screening may be free in solution, affixed to a solid support, borne on a cell surface, or located intracellularly. The formation of binding complexes, between the peptide or polypeptide and the agent being tested, may be measured.

One technique for drug screening which may be used provides for high throughput screening of compounds having suitable binding affinity to the peptide or polypeptide of interest as described in published PCT application WO84/03564. In this method, large numbers of different small test compounds are synthesized on a solid substrate, such as plastic pins or some other surface. The test compounds are reacted with the peptide or polypeptide, or fragments thereof, and washed. Bound peptide or polypeptide is then detected by methods well known in the art. Purified peptide or polypeptide can also be coated directly onto plates for use in the aforementioned drug screening techniques. Alternatively, non-neutralizing antibodies can be used to capture the peptide and immobilize it on a solid support.

In another technique, one may use competitive drug screening assays in which neutralizing antibodies capable of binding the peptide or polypeptide specifically compete with a test compound for binding to the peptide or polypeptide. In this manner, the antibodies can be used to detect the presence of a test compound which shares one or more antigen binding sites with the antibody.

EXAMPLES

The examples described herein are for purposes of illustrating embodiments of the invention. Other embodiments, methods, and types of analyses are within the scope of persons of ordinary skill in the molecular diagnostic arts and need not be described in detail hereon. Other embodiments within the scope of the art are considered to be part of this invention.

Example 1

Genome Size Estimation

*Methanobrevibacter ruminantium* strain M1$^T$ (DSM1093) was grown on BY+ medium (basal medium, Joblin et al., 1990) which consists of [g/l] NaCl (1), $KH_2PO_4$ (0.5), $(NH_4)_2SO_4$ (0.25), $CaCl_2.2H_2O$ (0.13), $MgSO_4.7H_2O$ (0.2), $K_2HPO_4$ (1), clarified rumen fluid (300 ml) $dH_2O$ (360 ml), $NaHCO_3$ (5), resazurin (0.2 ml) L-cysteine-HCl (0.5), yeast extract (2), and Balch's trace elements solution (10 ml) (added trace elements; Balch et al., 1979) which consists of (g/l) nitrilotriacetic acid (1.5), $MgSO_4.7H_2O$ (3), $MnSO_4.H_2O$ (0.5), NaCl (1), $FeSO_4.7H_2O$ (0.1), $CoCl_2.6H_2O$ (0.1), $CaCl_2.2H_2O$ (0.1), $ZnSO_4.7H_2O$ (0.1), $CuSO_4.5H_2O$ (0.01), $AlK(SO_4)_2.12H_2O$ (0.01), $H_3BO_3$ (0.01), $Na_2MoO_4.2H_2O$ (0.01), $NiSO_4.6H_2O$ (0.03), $Na_2SeO_3$ (0.02), and $Na_2WO_4.2H_2O$ (0.02). Genomic DNA was extracted by freezing cell pellets under liquid $N_2$ and grinding using a pre-chilled, sterilised mortar and pestle. Cell homogenates were imbedded in agarose plugs and subsequent manipulations were carried out in the plugs to reduce the physical shearing of genomic DNA. Digests were performed with restriction endonucleases and DNA fragments were separated using pulsed-field gel electrophoresis (PFGE).

Example 2

DNA Cloning and Sequencing

The DNA of the *M. ruminantium* genome was sequenced by Agencourt Biosciences Corporation (Massachusetts, USA) using a random shotgun cloning approach (Fleischmann et al., 1995) and by Macrogen Corporation (Rockville, Md., USA) using pyrosequencing. Briefly, libraries of *M. ruminantium* DNA were constructed in *Escherichia coli* by random physical disruption of genomic DNA and separation of fragments by gel electrophoresis. Large fragments in the 40 Kb range were retrieved from the gel and used to generate a large insert fosmid library. DNA fragments in the 2 to 4 Kb range were recovered and used to generate a small insert plasmid library. Clones resulting from both large and small insert libraries were grown, and their fosmid or plasmid DNA was recovered and sequenced using high throughput sequencing technology. A sufficient number of clones were sequenced to give a theoretical 8 fold coverage of the *M. ruminantium* genome. Additional sequence coverage was obtained by pyrosequencing of randomly sheared genomic DNA fragments (Macrogen Corporation) to a final theoretical genome coverage of approximately 10 fold.

Example 3

Sequence Assembly and Annotation

DNA sequences were aligned to find sequence overlaps and assembled into contiguous (contig) sequences using Paracel Genome Assembler (Paracel Inc, CA, USA) and the Staden package (Staden et al., 1998) in combination with sequence from both standard and inverse PCRs. Contigs were analysed using the open reading frame (ORF) finder GLIMMER (Gene Locator Interpolated Markov Model ER Delcher et al., 1999) and each ORF was analysed by gapped BLAST (Basic Local Alignment Search Tool (Altschul et al., 1997) against the National Center for Biotechnology Information (NCBI) non-redundant nucleotide and protein databases.

The contigs from the 8 fold draft phase sequence were joined at random by artificial linking of sequences to generate a "pseudomolecule" and submitted to The Institute for Genomic Research (TIGR, DC, USA) for autoannotation. The contigs assembled from the 10 fold pyrosequencing were reanalysed using GLIMMER and ORFs were autoannotated using GAMOLA (Global Annotation of Multiplexed On-site Blasted DNA sequences; Alternann and Klaenhammer, 2003). Automated annotations were subsequently verified manually. ORFs were categorised by function using the clusters of orthologous proteins (COG) database (threshold 1e-02) (Tatusov et al., 2001).

Protein motifs were determined by HMMER (hypertext transfer protocol://hmmer.wustl.edu) using PFAM HMM and TIGRFAM libraries, with global and local alignment (hypertext transfer protocol://pfam.wustl.edu) and standard and fragment-mode TIGRFAM HMMs models (hypertext transfer protocol://world wide web.tigr.org/TIGRFAMs) respectively (threshold 1e-02). tRNAs were identified by using TRNASCAN-SE (Lowe and Eddy, 1997) and nucleotide repeats were identified using the KODON software package (Applied Maths, Austin, Tex., USA) and REPUTER (Kurtz and Schleiermacher, 1999). Genome atlas visualizations were constructed using GENEWIZ (Jensen et al., 1999). Pathway reconstructions from the predicted M. ruminantium ORFeome were carried out in conjunction with the KEGG (Kyoto Encyclopedia of Genes and Genomes, Kanehisa et al., 2004) on-line database using in-house developed software (PathwayVoyager; Alternann and Klaenhammer, 2005).

Example 4

Sequencing Results and Analysis

Size estimation of, the M. ruminantium genome by restriction enzyme digestion of genomic DNA and sizing of fragments via PFGE, indicated a single chromosome of approximately 2.5-2.9 Mb. Initial sequencing of large and small insert clones (6 fold draft coverage) and assembly of the sequence into contigs indicated that a 40 Kb region of the genome was highly over-represented (>20 fold), particularly within the small insert library. This was possibly due to a high copy number plasmid (although no extrachromosomal DNAs had been identified) or a lysogenic bacteriophage that had replicated during the growth of the culture used for DNA extraction. Because of this large sequence bias, additional sequencing was carried out (2 fold theoretical genome coverage) for only large insert clones yielding a final 8 fold coverage from Sanger sequencing. The 8 fold draft phase sequence was assembled into 756 contigs which were linked via 105 scaffolds. Further pyrosequencing was carried out to an additional ~10 fold coverage and incorporation of these sequences into the assembly resulted in the contig number dropping to 27. Subsequent gap closure using inverse and long range PCR techniques reduced the contig number to 14.

The combined length of the 14-contig sequence indicate that the genome is slightly larger (2,920,443 bp) than the size estimated by PFGE (FIG. 1A) and significantly larger than its closest relative, M. smithii (1.9 Mb). The % G+C of 32.7 is close to the reported 27.5% to 31.6% range reported for M. ruminantium strains (Balch et al, 1979). Analysis of the sequence predicts 2672 ORFs and the total number of hits to protein families (TIGRFam and PFam) and Clusters of Orthologous Groups (COGs) are reported in FIG. 1B. All of the genes predicted to be involved in methanogenesis from $H_2+CO_2$ and formate are present (FIG. 1C; and FIGS. 6A-6C). However, the draft sequence of M. ruminantium lacks a methyl coenzyme reductase II (mcr II or mrt) system. In other methanogens, the mcr II cluster encodes an isoenzyme of the methyl CoM reductase I enzyme which is up-regulated during growth at high partial pressures of $H_2$ (Reeve et al., 1997). $H_2$ is used rapidly in the rumen and does not accumulate to high levels, so M. ruminantium appears to be adapted to use low levels of $H_2$ via the mcr I system only.

Comparison of the draft M. ruminantium genome with the closely related M. smithii and Mt. thermoautotrophicus reveals several regions of difference. Some of the gene differences encode very large surface proteins of the asparagine/threonine-rich large protein family that may contain CPOMP and DUF11 repeat sequences (chlamydial polymorphic outer membrane proteins, and domain of unknown function, respectively) that are likely to mediate interactions with surfaces or other microorganisms in the rumen environment (see FIGS. 7A-7C). Similar repeat sequences are also found in large surface proteins encoded in both the Ms. stadtmanae and M. smithii genomes (Samuel et al., 2007).

M. ruminantium has previously been reported to produce a capsule (Smith and Hungate, 1958) and sequence analysis shows that it encodes more than 50 genes (glycosyl transferases (GT), other transferases, epimerases and transporters) involved in the synthesis and export of exopolysaccharides confirming that it decorates its surface with polysaccharides (see FIGS. 8A-8C). M. ruminantium has at least 30 glycosyl transferases (6 GT1, 21 GT2, 2 GT4 and 1 GT66; see FIGS. 8A-8C) compared with 28 in M. smithii (1 GT1; 22 GT2; 4 GT4 and 1 GT66) and 41 in M. stadtmanae (2 GT1; 26 GT2; 12 GT4 and 1 GT66) (Samuel et al, 2007; Fricke et al., 2006; Coutinho and Hennssat, 1999). This is a relatively large number of genes devoted to encode surface polysaccharides by these organisms and suggests that this is an important factor for survival in gastrointestinal environments.

Nucleotide repeat analysis revealed the presence of at least two Spacer Interspersed Direct Repeats (SPIDRs) regions in the M. ruminantium genome. SPIDRs are nucleotide repeats (usually less than 40 nt) made up from identical units separated by heterologous sequences and were first characterised in prokaryotes (Jansen et al., 2002). The M. ruminantium SPIDR I has a unique genetic arrangement which consists of two identical repeat structures flanking a 17 kb region harbouring a cluster of associated cas-genes. Similar repeat structures have been found in several methanogen genomes. Methanocaldococcus jannaschii contains 18 copies of a multicopy repetitive nucleotide element (Bult et al, 1996) which consist of a long (391-425 bp) repeat segment followed by up to 25 short (27-28 bp) repeat segments which are themselves separated by 31 to 51 bp of unique sequence. The Ms. stadtmanae genome contains a 4.8 Kb region in which a 30 bp element is repeated 59 times (Fricke et al., 2006). Mt. thermoautotrophicus contains two extended repeats (3.6 and 8.6 kb in size) that contain a 372-bp repeat sequence, followed by 47 and 124 copies of the same 30 bp repeat sequence separated by unique sequences 34 to 38 bp in length (Smith et al., 1997). The biological function of these SPIDRs is unknown, although a current hypothesis speculates that this system is a functional analog of the eukaryotic small interfering RNA systems and represents a defense system against foreign replicons that functions on the antisense RNA principle (Jansen et al., 2002; Haft et al., 2005; Godde and Bickerton; 2006; Makarova et al., 2006).

Figure 9B-206:
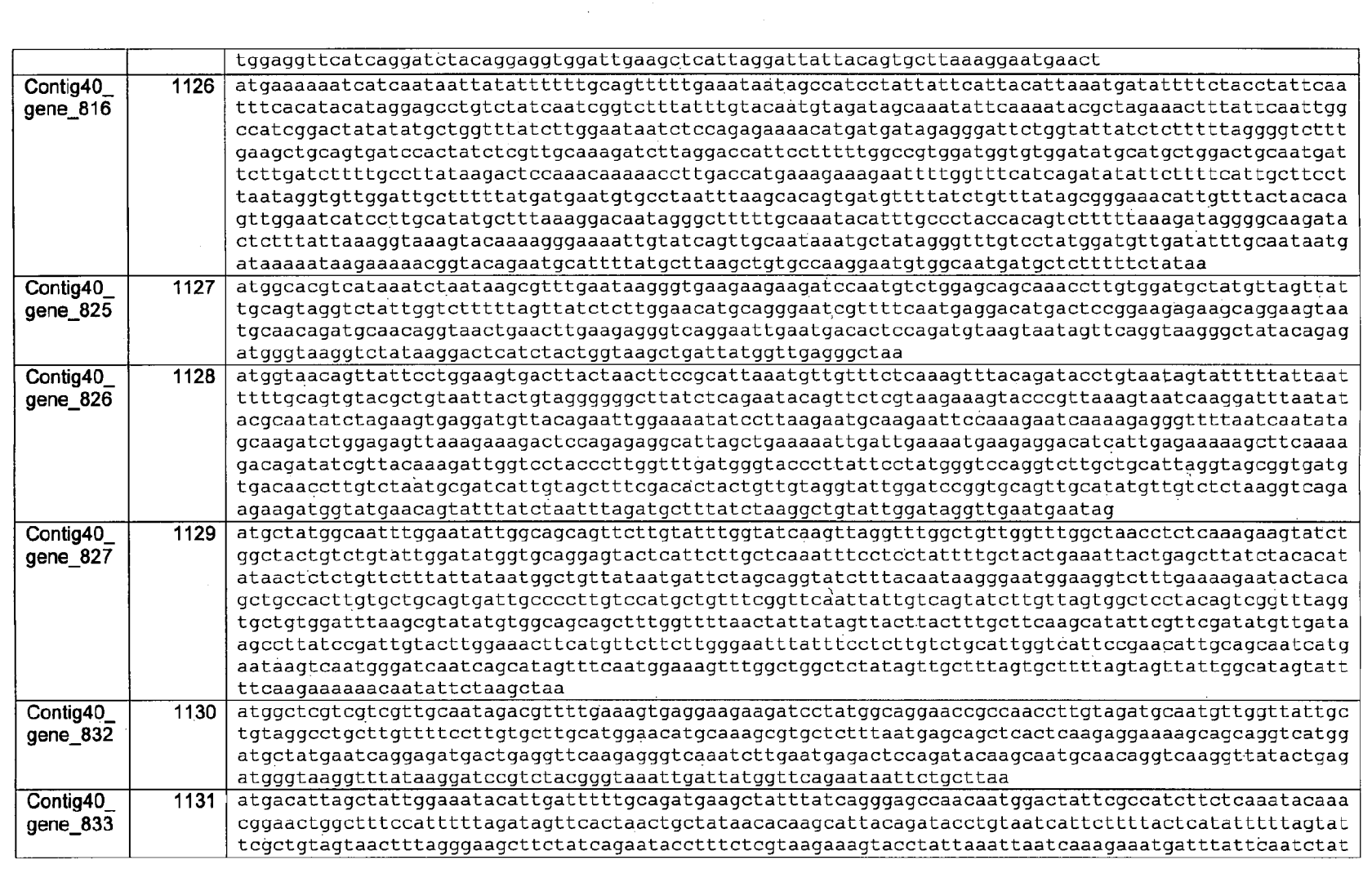
Figure 9B-223:
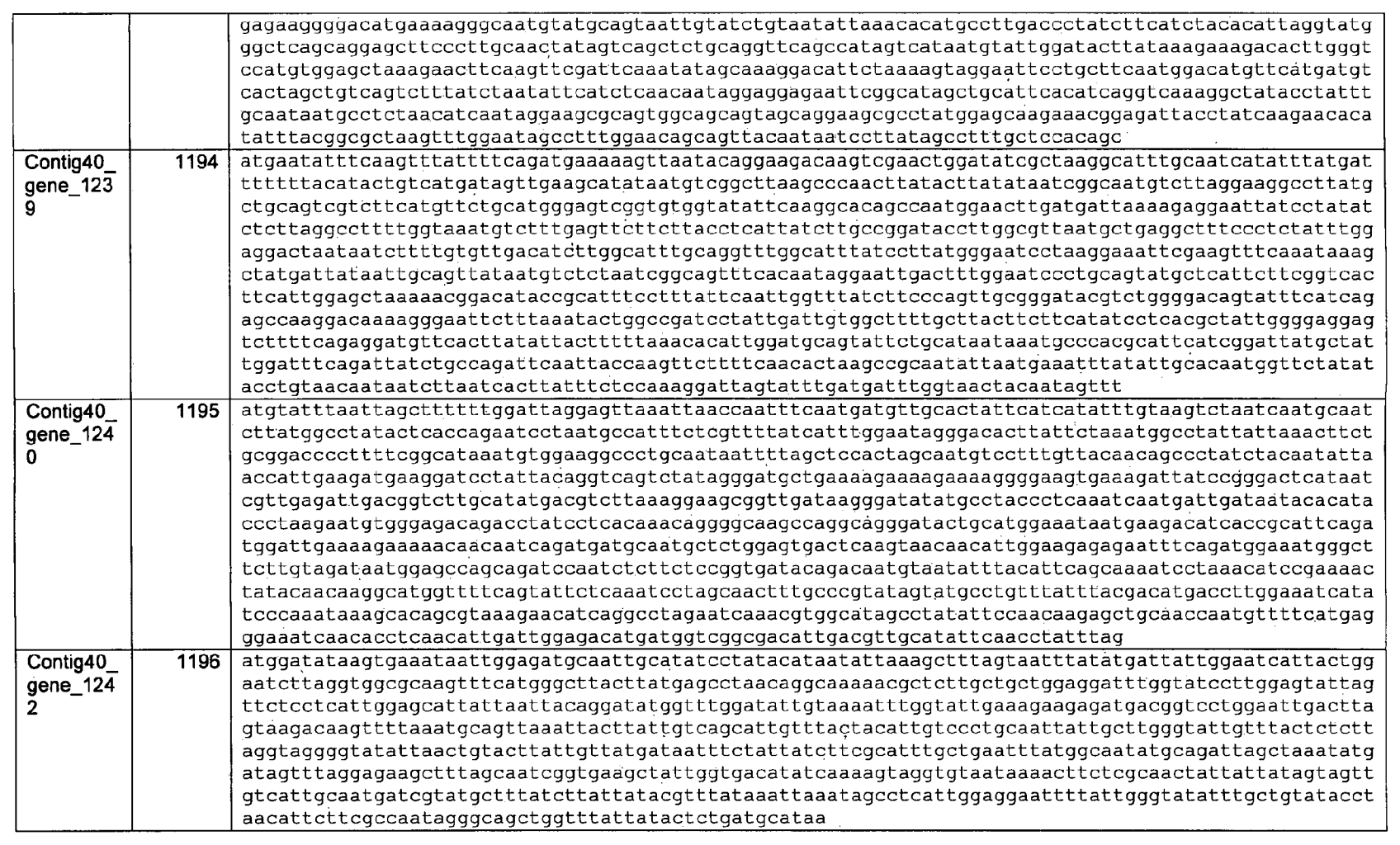
Figure 9B-248:
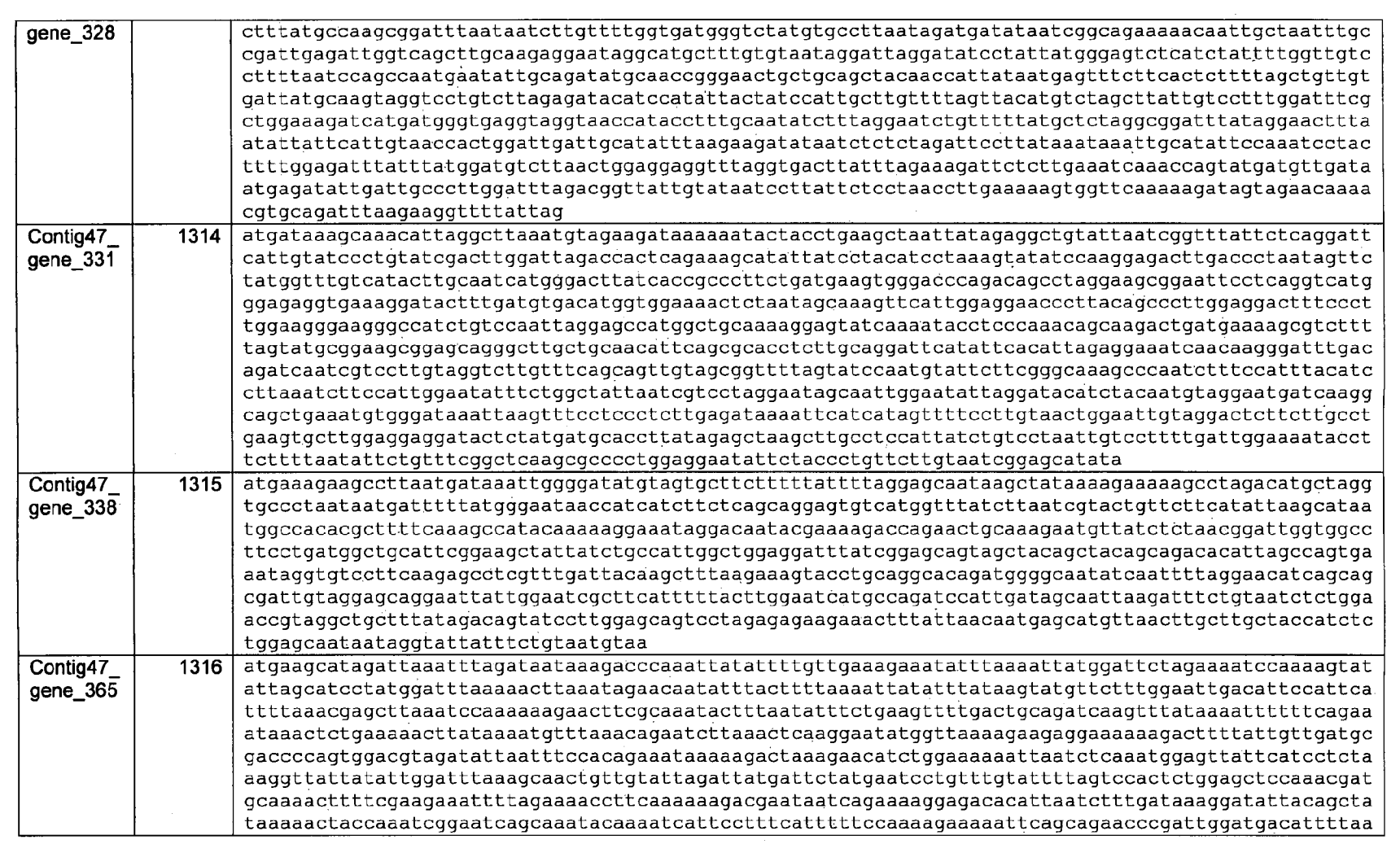

The *M. ruminantium* genome also encodes a large number of ORFs predicted to encode proteins with membrane-spanning domains, which consequently are expected to contain regions that are exposed on the cell surface (FIGS. 9A, 9B and 9C).

Example 5

Antibody Production and Testing

Preparation of Cell Walls from *M. Ruminantium*: Cell Walls from *M. Ruminantium* were prepared by freezing cell pellets under liquid $N_2$ and grinding using a pre-chilled, sterilised mortar and pestle. The finely ground cells were resuspended in trypsin-phosphate buffer (40 mg trypsin/200 ml of 0.1 M phosphate buffer, pH 7.9) and incubated at 37° C. for 2 hours. The preparation was then centrifuged at 48,000 g for 30 minutes at 4° C., and the resulting pellet was washed twice with sterile distilled $H_2O$ and freeze dried.

Antibody production: Nine peptide sequences which were predicted to be located external to the cell were identified from the *M. ruminantium* genome sequence and selected as potential antigens. Five milligrams of each of these peptides were synthesized (Invitrogen) and their purity checked by mass spectroscopy. The peptides and their coding sequences are shown in FIG. 4. The full nucleic acid and amino acid sequences are shown in FIG. 5. Two milligrams of each peptide remained unconjugated for ELISA and 3 mg was conjugated to Keyhole Limpet Hemocyanin (KLH) for animal immunisation.

The vaccination programme is summarised in FIG. 2 and proceeded as follows. Each immunization used one sheep (1-3 years old) which was pre-bled to give 2-5 ml of preimmune serum on Day 0. This was followed by primary intradermal (ID) injections of 200 μg of conjugated peptide in CFA (Complete Freund's Adjuvant) at 10-15 sites on Day 0. Intradermal (ID) injections of 200 μg of KLH-peptide in IFA (Incomplete Freund's Adjuvant) at 10-15 sites were made on Day 14, and 200 μg of KLH-peptide in CFA at 10-15 sites on Day 28. A further five intradermal (ID) injections of 200 μg of KLH-peptide in IFA at 10-15 sites were made on Days 56, 70, 84, 98 and 112. Four test bleeds (2-5 ml) were made on Days 42, 56, 84, and 112. A production bleed giving approximately 1,000 ml of antisera was made at the end of the standard protocol.

The antibody titer was determined with an enzyme linked immunosorbent assay (ELISA) with peptide-GGG (goat gamma globulin) bound in solid phase (0.1 μg/100 μl/well) on high binding 96 well plates. The serum was first diluted 50 fold and then further diluted in 2-fold serial dilutions. The ELISA Titer was calculated as the estimated dilution factor that resulted in an OD at 405 nm of 0.2 and was derived from nonlinear regression analysis of the serial dilution curve. Detection was obtained using an HRP conjugated secondary antibody and ABTS substrate.

The sheep antibody responses to vaccination are shown in FIG. 3. All sheep sera had titres at 6 weeks which were at least 32-fold greater than pre-immunisation (1:1600). The most antigenic preparation was the mtrD peptide which had a titre 1024-fold greater than the pre-immunisation level. The least immunogenic preparations were the mtrE peptide, the ORF508 and ORF819 surface protein peptides. The *M. ruminantium* cell wall preparation induced a good antibody response (256-fold higher than pre-immune levels) but this was not sustained longer than 15 weeks despite several booster shots.

Antibody binding to *M. ruminantium* cells: An ELISA assay was used to measure antibody binding to *M. ruminantium* cells as follows. MaxiSorp ELISA plates (Nunc) were coated with *M. ruminantium* whole cells (40 μl of cells into 2 ml of sodium carbonate buffer) and with *M. ruminantium* cytosolic protein fractions. The serum samples were diluted 1/20 (25 μl into 475 μl diluent) in PBS Tween 20 containing 1% w/v casein, and incubated at room temperature for 1 hour. The plate was washed 6 times with PBS Tween 20. A negative control serum was included, and this was obtained from a sheep which had not had colostrum as a lamb.

For detection the conjugate used was donkey anti sheep/goat IgG HRP (Batch 061005 Star 88P by Serotec) and 50 μl of a 1/5000 dilution (2 μl into 10 ml diluent) was added to each well. The 3,3',5,5' tetramethylbenzidine (TMB) substrate was then added (50 μl/well) and the reaction incubated at room temperature in dark for 15 min. Stop solution (0.05 M $H_2SO_4$, 50 μl/well) was then added and the plate read at 450 nm.

*M. ruminantium* growth inhibition test: The immune serum samples were thawed in the anaerobic hood, and 0.1 ml from each of 10 samples was placed in a 1.5 ml microcentrifuge tube. The mixture (1 ml) was incubated at room temperature with the lid open in the anaerobic hood overnight to remove any dissolved oxygen. The preimmune serum served as a negative control. The combined serum sample (0.3 ml) was added into 5 ml of growing *M. ruminantium* culture in Hungate tubes in triplicate in the anaerobic hood. Gas (80% $H_2$ and 20% $CO_2$) was pumped into the Hungate tubes and the cultures were incubated at 39° C. on a shaker (100 rpm). Methanogen growth was monitored by measuring the OD at 600 nm with a spectrophotometer and by gas chromatograph determination of hydrogen usage and methane production.

ELISA assays showed that antibodies generated from each of the antigens bound to *M. ruminantium* cells fixed to microtitre plates. Antibodies were shown to bind to *M. ruminantium* cells in vitro, although single antibody preparations added to *M. ruminantium* cultures did not inhibit methanogen growth or reduce the amount of methane formed. However, a preparation consisting of pooled samples of antisera from each of the 10 different antigens, appeared to increase cell aggregation when added to *M. ruminantium* cultures.

Example 6

Overview

*Methanobrevibacter ruminantium* was chosen for genome sequencing because of its prevalence in the rumen under a variety of dietary conditions (based on cultivation and molecular detection data), the availability of cultures, its amenity to routine growth in the laboratory, and the relatively large amount of previous studies and background literature available for this organism. A significant number of the genes within the *M. ruminantium* have been assigned a function, and have thereby allowed a detailed picture of this organism's lifestyle within the rumen. *M. ruminantium's* dependence on simple substrates ($H_2$+$CO_2$, formate) and its interaction with the rumen environment via surface proteins and exopolysaccharides are important targets for inhibition. Similarly, the SPIDRs hold promise for both specific targeting of *M. ruminantium* and for future genetic manipulations to assist in determining gene function. The sequence data elucidates the metabolism of this organism and how it interacts with other microbes, and points to conserved systems and components among methanogens that can be inactivated to prevent or reduce methane formation in the rumen.

REFERENCES

Altermann E, Klaenhammer T R (2005) PathwayVoyager: pathway mapping using the Kyoto Encyclopedia of Genes and Genomes (KEGG) database. *BMC Genomics* 6:60-66.

Alternann, E., and T. R. Klaenhammer. 2003. GAMOLA: a new local solution for sequence annotation and analyzing draft and finished prokaryotic genomes. Omics 7:161-169.

Altschul S F, Madden T L, Schaffer A A, Zhang J, Zhang Z, Miller W, Lipman D J (1997) Gapped BLAST and PSI-BLAST: a new generation of protein database search programs. *Nucleic Acids Research* 25, 3389-3402.

Balch W E, Fox G E, Magrum L J, Woese C R, Wolfe R S (1979) Methanogens: reevaluation of a unique biological group. *Microbiological Reviews* 43, 260-296.

Baresi, L. and Bertani, G. 1984. Isolation of a bacteriophage for a methanogenic bacterium. In *Abstracts of the Annual Meeting of the American Society for Microbiology*. Washington D.C.: American Society for Microbiology, p. 133.

Bickle, T. A. and D. H. Kruger. 1993. Biology of DNA restriction. Microbiol. Rev. 57:434-450.

Bult C J, et al. (1996) Complete genome sequence of the methanogenic archaeon, *Methanococcus jannaschii*. *Science* 273, 1058-1073.

Coutinho P M, Henrissat B (1999) Carbohydrate-active enzymes: an integrated database approach. In 'Recent Advances in Carbohydrate Bioengineering' (Eds H J Gilbert, G Davies, B Henrissat and B Svensson) pp. 3-12 (The Royal Society of Chemistry, Cambridge) (Carbohydrate Active Enzymes database, hypertext transfer protocol://world wide web.cazy.org/).

Delcher A L, Harmon D, Kasif S, White O, Salzberg S L (1999) Improved microbial gene identification with GLIMMER. *Nucleic Acids Research* 27, 4636-4641.

Fleischmann et al., 1995. Whole-genome random sequencing and assembly of *Haemophilus influenzae* Rd Science 269: 496-512.

Fricke W F, Seedorf H, Henne A, Kruer M, Liesegang H, Hedderich R, Gottschalk G, Thauer R K (2006) The genome sequence of *Methanosphaera stadtmanae* reveals why this human intestinal archaeon is restricted to methanol and $H_2$ for methane formation and ATP synthesis. *Journal of Bacteriology* 188, 642-658.

Godde J S, Bickerton A (2006) The repetitive DNAe called CRISPRs and their associated genes: evidence of horizontal transfer among prokaryotes. *Journal of Molecular Evolution* 62, 718-729.

Haft D H, Selengut J, Mongodin E F, Nelson K E (2005) A guild of 45 CRISPR-associated (Cas) protein families and multiple CRISPR/Cas subtypes exist in prokaryotic genomes. *PLoS Computational Biology* 1:474-483.

Jansen R, Embden J D, Gaastra W, Schouls L M (2002) Identification of genes that are associated with DNA repeats in prokaryotes. *Molecular Microbiology* 43, 1565-1575.

Jansen R, van Embden J D, Gaastra W, Schouls L M (2002) Identification of a novel family of sequence repeats among prokaryotes. *OMICS: A journal of integrative biology* 6, 23-33.

Jensen, L. J., Friis, C. and Ussery, D. W. 1999 Three views of microbial genomes. Res. Microbial. 150, 773-777.

Joblin K N, Naylor G E, Williams A G (1990) Effect of *Methanobrevibacter smithii* on xylanolytic activity of anaerobic ruminal fungi. Applied and Environmental Microbiology 56, 2287-2295.

Kanehisa M, Goto S, Kawashima S, Okuno Y, Hattori M (2004) The KEGG resource for deciphering the genome. *Nucleic Acids Research* 32, D277-D280.

Kiener, A., Konig, H., Winter, J. and Leisinger, T. 1987. Purification and use of *Methanobacterium wolfei* pseudomurein endopeptidase for lysis of *Methanobacterium thermoautotrophicum*. J. Bacteriol. 169, 1010-1016.

Knox, M. R. and Harris, J. E. 1986. Isolation and characterisation of a bacteriophage of *Methanobrevibacter smithii*. In *Abstracts of the XIV International Congress on Microbiology*. Manchester. International Union of Microbiological Societies.

Kurtz S, Schleiermacher C (1999) REPuter fast computation of maximal repeats in complete genomes. Bioinformatics 15, 426-427.

Lowe T M, Eddy S R (1997) tRNAscan-SE: a program for improved detection of transfer RNA genes in genomic sequence. *Nucleic Acids Research* 25, 955-964.

Loenen, W. and N. Murray. 1986. Modification enhancement by restriction alleviation protein (Ra1) of bacteriophage lambda. J. Mol. Biol. 190:11-22.

Lucchini, S., F. Desiere, and H. Brussow. 1999. Comparative genomics of *Streptococcus thermophilus* phage species supports a modular evolution theory. J. Virol. 73:8647-8656.

Luo, Y. N., Pfister, P., Leisinger, T. and Wasserfallen, A. 2002. Pseudomurein endoisopeptidases PeiW and PeiP, two moderately related members of a novel family of proteases produced in *Methanothermobacter* strains. FEMS Microbiol. Lett. 208, 47-51.

Makarova, K. S., Aravind, L. and Koonin, E. V. 1999. A superfamily of archaeal, bacterial, and eukaryotic proteins homologous to animal transglutaminases. Protein Sci. 8, 1714-1719.

Makarova K S, Grishin N V, Shabalina S A, Wolf Y I, Koonin E V (2006) A putative RNA-interference-based immune system in prokaryotes: computational analysis of the predicted enzymatic machinery, functional analogies with eukaryotic RNAi, and hypothetical mechanisms of action. *Biology Direct* 1:7-32.

New Zealand Statistics 2005 (www.stats.govt.nz)

New Zealand's Greenhouse Gas Inventory 1990-2004. The National Inventory Report and Common Reporting Format. (2006) Ministry for the Environment. Hypertext transfer protocol://www.mfe.govt.nz/publications/climate/nir-apr06/nir-apr06.pdf.

Rawlings, N. D., Morton, F. R. and Barrett, A. J. 2006. MEROPS: the peptidase database. Nucleic Acids Res. 34, D270-D272.

Reeve J N, Nolling J Morgan R M, Smith D R (1997) Methanogenesis: genes, genomes and who's on first? *Journal of Bacteriology* 179, 5975-5986.

Samuel B S, Hansen E E, Manchester J K, Coutinho P M, Henrissat B, Fulton R, Latreille P, Kim K, Wilson R K, Gordon J I (2007) Genomic adaptations of *Methanobrevibacter smithii* to the human gut. *Proceedings of the National Academy of Sciences USA* 104, 10643-10648.

Smith D R, et al. (1997) Complete genome sequence of *Methanobacterium thermoautotrophicum* ΔH: Functional analysis and comparative genomics. *Journal of Bacteriology* 179, 7135-7155.

Smith P H, Hungate R E (1958) Isolation and characterization of *Methanobacterium ruminantium* n. sp. *Journal of Bacteriology* 75, 713-718.

Staden R, Beal K F, Bonfield J K (1998) The Staden Package. *Methods in Molecular Biology Bioinformatics Methods and Protocols* 132, 115-130.

Tatusov R L, Natale D A, Garkavtsev I V, Tatusova T A, Shankavaram U T, Rao B S, Kiryutin B, Galperin M Y, Fedorova N D, Koonin E V (2001) The COG database: new developments in phylogenetic classification of proteins from complete genomes *Nucleic Acids Research* 29, 22-28.

All publications and patents mentioned in the above specification are herein incorporated by reference. Where the foregoing description reference has been made to integers having known equivalents thereof, those equivalents are herein incorporated as if individually set forth. Although the invention has been described in connection with specific preferred embodiments, it should be understood that the invention as claimed should not be unduly limited to such specific embodiments. It is appreciated that further modifications may be made to the invention as described herein without departing from the spirit and scope of the invention.

SEQUENCE LISTING (1396 sequences)

SEQ ID NO: 1 - protein, 14 aa, Methanobrevibacter ruminantium
IIAAFKLKGLEMLC

SEQ ID NO: 2 - protein, 15 aa, Methanobrevibacter ruminantium
YNIGGTIEGFVDPKC

SEQ ID NO: 3 - protein, 15 aa, Methanobrevibacter ruminantium
CTLPLDGLGHPFPLP

SEQ ID NO: 4 - protein, 16 aa, Methanobrevibacter ruminantium
YQSSTYGSDGGYDDKC

SEQ ID NO: 5 - protein, 16 aa, Methanobrevibacter ruminantium
VQSGEVSGGVDIASSC

SEQ ID NO: 6 - protein, 16 aa, Methanobrevibacter ruminantium
VADIWNGSSNSVDAYC

SEQ ID NO: 7 - protein, 17 aa, Methanobrevibacter ruminantium
FTDNQATGSSNGGGAIC

SEQ ID NO: 8 - protein, 16 aa, Methanobrevibacter ruminantium
SKSNFVINGNGHTIDC

SEQ ID NO: 9 - protein, 15 aa, Methanobrevibacter ruminantium
CYKISENNGNKSYDI

SEQ ID NO: 10 - protein, 233 aa, Methanobrevibacter ruminantium
MDQVIACLGAVCAILWGVLAIRSVASYGLGTGVPSIGYMSLGIGVIGALAGVGIIAAFKLKGLEMLGPILALVFAMLIGLLVAIVAKKIVGMKIPVMERCTAEIAGAAALAVLGFSSAIAGGYSIDLLLTAVVAPGFIALFYILVTMAIQHPFNACLGPNEDQVRTLKCGASTAFLTMIITGILAISAGGYAWFAILVVGLIGWYVSFKMFVNASYEAAASVKWSGLWPKVEE

SEQ ID NO: 11 - protein, 233 aa, Methanobrevibacter ruminantium
MDLLIFIICVVIAGIIMGGGVHFIPVGGAPAAMATATGVGTGTAMLAAGAGLTGLITAASMTGQPVWLIVLAGAVGSMLMMGITMLIGNFIYIFGVGVVPASGKAAVDPITGWNQEKYKTPGTEGHGIPTVCYISGIIGGLLGGAGGGLVYWAINEFATANLTGFDATVIAGLAAILSVGMFFINSVTASYNIGGTIEGFVDPKFKRLPTGILACAVVSLVAAIFMVLMIGGI

SEQ ID NO: 12 - protein, 290 aa, Methanobrevibacter ruminantium
MDPITLGVVALMGAAATIAGAAEDLESDIGSQSNPNSQVQLAPQMGHLHRMINKAASGEPVAYGCWCGISGAIAALAMGMGIIPIVAIAMGSTVAALVHAIYTVTSHMGRIVGQSQFEQPLFMDVLTQSLGPIAAHGFIASFGIVGIAYLMTLPLDGLGHPFPLPLLAVLWGITIGAIGSSTGDVHYGAESEYQKFDYGGGTPVAIQGDIVTKAPLGAKNSIDVGNFCAKYGGPLTGFCFGLIVFVSFWITVVFGALGGQIVGIVIVILLIAANYLLEKSTRAKFGPYEE

SEQ ID NO: 13 - protein, 1875 aa, Methanobrevibacter ruminantium
MKYNKKIFFLFLLLCLIIPQAIYAGDVDDLSDAGNYTRDNSPLTISSTYQSSTYGSDGGYDDKNENIYILDKVSDGDKSKTCCSKDLSLDNACSMDKSSCSKSNSACSKGISSDKDSSNLSNTYLVSENNYNDFNVDIDLNDKLSDLDLNNDLSLNKDLTLNLNSNNDMDYLNLEEVIQTDGTLTYEGDLDQTYLNDESLNQDVQNDDSLNKNDLKSPLSDENTFNIFIISDNTGNNLFDAVACEILDNSNFSNVKFNIRSGNQINAMSEDEIYELMAPCDAFIGQWVSSNVDAVLTSLLNNHPELSNKKLFLILEPPTGNINSSSSSLNLVRNSTIDYKKIFNGISNDDLINYFKATKRGNNFESIQEYIDNEGSSFNSIFNNLVLYKDINDKANLKNELLYILYLLGHGCSYESANFTGVQASGIFRDRWYSFDEYVLTFFNESRNRTIGILESTMYIQSQQLDLVNEITERLESKGYNVIPIYCPAGNAEQLNIMVKYWTSACSNISGFLENPQDFDIYVDGIISMVAYGVGGENFTNATKFFEDANVPIFRAVHSEYITNEQWELSPVGLSTTKSDKWWHVTIAESQGIFDATYVGGVDSYISNRTGAIILTFVPVHENIELLTDRVDAWVDLKYTPNEDKNISIVYYNYPPGKQNIGASYLDAITSVYNMLYTLKDEGYYLTDLPNNVSELEDMMIACGINVANWAPGEVEKLANRSGVALLPVDEYLEWFDSLDDIVKVQITEGPVAYIGQMVRRAVLINYTDEVETMVNDWYNQIKALLPENQTVAATNILDKLVNSLKLYANASSDGDENASLYYDEFLRYYDEFKSLNVSGLNGWGEAPGNIMLVNRNGTDYFVIPGLTFGNVFIGPEPQRGWEADIENLYHCTAVAPTHQYLAAYYYMQTRQSNAMVFVGRHATHEWLPGKEVLLSYNDYGSIVVGKVPQVYFYITDGLAEAIQAKRRGFAVLISHLDSPKSYTHLYGNLTVLATLLEEYDNNHIIIESDSDKDNQAITYQVIKDNQTITYQVINQELEDNLTRAIKDLVIANNYYLTIGFTAEELNNTDMFSLSSTLNAFLKNTQNTLYPLGLHAIGQKWTDEDLANTVAIIVSHDFEYGGKKTNLFDQLSLYYYGEKYSNLTPLKRDYILNRSVDVCKALIYWDTETVSDTIGIGSPEFIESLNIAKKYIDLYNQCISLELEEMVSALNGGYVPVNIGGESVTVPQVLPTGANMYQDQSSELPTQKAWDYAKTLSLLTLADLNDTTEKIIMGIWCVETARDDGALVSTVLYLLGMEPVWHNSSSAGFDEEGIPTGKKVEDLPNVIALENLTRPDGWAKKRIDVTVITSGLFRDLYSSQARLMDNAYRMALACSYYTIVNNKTIMDSEYGPQVYDALRSIMRSISFKGMSNESLEDNYVAKHWLEDCIYYLSLGYNSTVSGEYAITRIFAPPNGDYGAGISKLVSMSWTWNDTDELSEFYIGRMGNMYSKYYWGDTNPVVFMRALSDTDHIVVSRNTNQYGVLDNDDFFDYWGGLSMTVEYLSNKTPTMNVLMYANKDNAYVATFENVFYNELNTRYLNPEWIKGMMQEGYSGSRYMSNKFISNLWGWQVTRPSSVSETVWDDVYNTYYKDKYGLGVKSWLQSGNNAYSLISMSGTMLNSAYSGYWDADDATLSDIANTWAQATVANGVACCDCSCGNVAMMQWAFKYVNADLLAKLMPKLYDATQNPLFYTNSSDMPTNSSNIDRRTTNSSAESNNTETVQTNSSSNSQQSANGNTNIPGASGGYMVGTEADAQSDMASDSDAGMNDANGEGRSVEVTKSTSTPVAPKDVSMPIAIIVCVICLVALIGFGYFRNRKDDDDYYNDDDDDDYEYK

SEQ ID NO: 14 - protein, 1787 aa, Methanobrevibacter ruminantium
MSFGAVSAADLNTVQSGEVSGGVDIASSNPGVENGELTYEIPDSVENIQYAGLFVDSYTAGSSNLVYGSEANITLTKNGESEQIASERLVASVGSADGEVYVINDHTTKCFADYMMTYNLTDRLQDAKGNITITVNATPIEGYTFYNKIKLIGLVFTYDDGDGDQFHYWVNAGSSWVKTDSGETSKATFKLGNVNYDPTVATLDNFALSSQDGVYTFNGKEMDESIVTETGVYYYIHHKFDILDKIKNMTNTLVYTPGEGSYSFRNVLSVVKLVKTVPVYAKVNISSEYDDIVFSGTENLLKVGITNNGTGSASYLLDLYADGKKVNSSQISLAAGREAVISLIDNTIRPSAADTVSGADNKKINYTVVVSDKNTGEVLDESSIFPNLLYNGYLGKGLAYPAEKISSFKNITVNGGMIIESLGDSTYLDASMTGKTDSWTIDLPDGAFFTDAFVYVPYNLDNGNVPMFTSTFNGAAVNPIASYRDQPNIGENAKNGYGLLVYDVGELIKAGVNSFALSKEAGIAGVYPSTLIAFYNLTDSDLLTSAFIFNGADLLSNEYNSLGRDVSSDNILSIGAFDGLVSAKLHVFAADCQAGEGDLTVNGKSYKNVWAGTNRSVGDYVVDLGKSTNASNEVSFISTASNILALQQLAVVQYNVPSVKASLVSEYSNAVFAGTNNVLSLNITNNGKFDSIYTVDFYVDGKKQNSTEISLKSGANKGLYLIDDTIRPIDASTVNGADNPKVNYTVVIIDKEKSMVLDEITITPSLLYNGNLGKDLAYPAENITSFRNITVSGGVIVDTLDDSTYINSQATNRTDIWNVNVADGDVFTDAFVYVPYNWDKTNGYMPVWNARFNGVAVSPLVSYRDQSNIGFFGKNGYGLVVYDVSKLIKSGENTFTLEKEAGITAVYPSTLMAFYNATSSNSLKTIYIYNGADLLANENNFLNRTVASDSHLDISSFKEVISAKLYVFSAGAQKGEGNIIFNNKTYKDVWNGTVNSVDSFIIDLGKSPSVSNDVSFVSTGSTIMALQQLIVLDYYVSSVKANVSSEYSGAVFAGTDNVLKVDLTNDGQGGSVYVLDFYIDGKIVNSTEIPLDAGKSTEIFLVDDKIRPVDASTVNGANNAKVNYTITVTDKASGLVLYEASLNPIVLYNGNLGKDLAYPAENISFFDAITVNGGVIIDTLDDSTYLGAKTTGRTDVWKVEIPKDGKIVDGFVYVSYNWDKTNGSMPIWNVSFNGVSVSPVAHYRDQSNMGTYGKYGYGLVVYDVGELIKSAENKFTLEKENGTTAVYPSTLLAFYNRTESNNRTTVYMYNGADLLSNANNFLGRTVASNAALDLALNPNDEIKSSRLYVFAASGQSGEGKLIVNNKTFNNVYNGSANSVDAYIIDLGKSPSASNNVSFIATGSTILALQQFVVVDAIHQSSEELQKMINSARAGSTLNLGSNVFKDVSNVIINKDLTITGGTIYAREGETIFVVTDRSAGGPKEVNITGVKFVLDNANTILQARAVNGSTPTSIDVASINIKKNNISFVDDDVVPESITVLDLKSQRSSIAPTRNLTISGNNLIAGICPFMFEVTSFNGKDSVVVPEGGNIPDKKASVIHYEDMVTTAINTNIEGRVGKYFEVNLTDSNGNPLKDKKVQIGFNGVVYDRTTNATGGVKLQINLGYKGTYTFAIAFLGDDYYNGSFVVAKIKVNTQKTKISTSSKTYKASAKTKAISATLKDASSNPISGKKLSFTVNGKTYSATTNSKGTATVNVSLSKKGTYSFTVKYAGDDMYAGATSSSKVVIK

SEQ ID NO: 15 - protein, 3451 aa, Methanobrevibacter ruminantium
MKNRKFLIVSLILIVLMLALGSAYAADLSPVTNGTVSGGVDVATANPYASQTGGQEIQSGELSYDVPEDVSDVQYAGLFVNVYGGSAQGDYGAQSNVSITSNGETSQIASESLNYTDGSGDGTVYIVNDHITKVYSDYQMIYNITDRVQGATGQIKINVTNTKLEGYANFDGRIKLIGLVFAYNDGSNNRFDYWVDSGQAWSNSADSVTKANFTVGTVSPFLSANIRNIALSSTDGNYSFNKQELTGGELISDSMFKYHKWDVTDLLKNKTNNLTFNSTKSFKNVLSVLTVTKNLEEIFVSPDGTGTGTTADDPTTMDKAAPALANNGIIHVLDGTYTQSKRYDIRANYSSIVAVNPGNVIFDGNNSVANIRVYGANVTLDGLTFTHGKGTGGGVYFDSDANGGLVTNCIFKDINNTGAGGAVYISGSKNVMIENCKFINTTSTGTGGGAIYIAGDNATVKECSFENATGKDGGAIRVNSRDFAVVRDSNFTGCVATTGGAISWVGKYGNVTNCTFTDNQATGSSNGGGAIYWQENFGLINNCTFIRNKAQVYGGAVNWAAGKINGTIVNSIFKENSAGRDGGAYYSAAGANEMLIMYCSFEDNEADANGGAMGFRADQCYLLDCNFTSNHAKQNGSAVMLYSNVANFLGIGNCNFVDNSADVLNYSIVNNAGKLKLSENNITTNDLRDGIYTNGSILTDVYLYLIVNETNDAASNVVYADIGDEVPIDVYLVDDNSNLINGIGLSVEINGTNITEFDLDGYTYKTSYTPSEIGTYYVTGNYSKAELSNILTGSIVVGEEPVSAIEIAFRGEYVNTTYAGVENLIAVSLHNTGSLDGNYLVEFYVDGELAGTEESKVNAGYTSDINFIDEKIRDLNESTILGHDNLQANYTVIVKDNETQEVIGESSYFPYVLYNGYLSKKYEYSDEFISSFRNVTFNGGYFINTTGSYSGNSNPGLTDIWTLPALGEGASFAGAYVYVAYTWDKTENGPSDWASSFNDESIPIVAQYRDQSNMGTSGSYGYGLVVYDVSSLIKEGQNKYSLTKGDTAIYPRTLVAFYNVTESSTVKTMYMYNGADLLYYGSYNVLERLVMTDSVLNISTEGNVLGSNLYVFAASAQAGEGNLLVNGEKYEDVWNGTTSSVEEKVFDLGDNPLASNEISFVSTGSTILALQQFVLVEYEAYSADVTIASEYNGACYAGTENALKVNVTNDGLEKANYLIELYADGVRVDYEHVEIDVGESNVLTLIDDTIRPVTEDTVNGADNQKVNYTVYVSAAGSLLAEKTITPTIWYNGYLGKDYAYPNETISYFDTITVNGGVIIETLNDTTYMGATVLNRTDVWELDVPDDVEFADAFIYIGYNWDKTGANIPVLNLTFNGETVAPMESYRDQSNLGSSGKYGYGLIVYDVSGLVEAGENTLLIEKEFNKTAVYPSTLVAFYNQEVPDVITTVYMYHGADLLYNSYNLLGRDVESNSVLEVELVDDLASADLLVFAASAQAGEGNLIVNNETYENVWSGSTNSTNVFGVDILDSLKQSNEVSFVSTGGTILALQQFIVFEYDVTSAKAKVSTEYSNSAYAGTDNVLKLDLTNNGTVDTVYHIDLYADGDLVDSIEAEIDCGENSTLYLIDDTIRPVTENTINGNNNAKVNYTVVISDNATDEILDEITITPVLVYNGYLGKDYAYPNDTIQFFDAITVNGGVIIDTLNDTTYLGTKTTNRTDVWTVDVPNDAEFVEAFVYLAYNWDKTNGTCPVFNTTFNGETVTPIAHYRDQSNLGTSSAKYGYGLLVYDVSEYIAAGENSFELLKDYDVTAVYPSTLVAFYDVEDSPILTTAYMFNGADLLYNAYNFLGRPVESNSVLYIDSVDDIDEATLVVFAASGQAGEGNLIVNGDEYTNVWEGTSNSAAAYMINLTDSIAESNNVSFVSTGGTILALQQFVIVSEYAPYAKADIISEYKGVAFAGTNNVLKVNVTNVAEEDAVFNVTLYADGVEIGSQLIEVGAYGSAIAMFTDEKIRPVTENTVKGADNEKVNYTAVVRDVDDLVEDAEATITPDILYNGNLGKDLAYPAEEITFFDSITVNGGIYIEIQNDSSYLASGATNRTDIWNIEAPEDADFVAGFVYVAYNWDKTSAGIPALNITFNGVSVAPVAHYRDQSNMGTYGKYGYGLLVYDVSDLLEAGDNVFTLTKDANMTAIYPSVLVAGYDQEVSDSMKTIYMFNGADLLSNANNFLGRVVASNSVLDIELPDDVIDCALGIFAASSQKGEGNLIVNGESFEDVWNGSSNSVQACVFNLTDDIEESNTVSFVATGSTILALQQFIFVEYELVSVDAKLGSEYNNVAFAGTDNVLEFNITNDGTIPTAYTIEFYIDGELADTLELELANGESDSLYLVDPTIRPVDETTVNGADNAKVNYTVVITDNSTGDVLDIITITPSVLYNGNLGKDLAYPAGEITFFDVITVNGDIIVIGMNDSTYLGSKTTGRTDVWDLTTNEDIIFAAGYLYVAYNWDKTPAGMPVWNTTFNGVTVTPVAHYRDQSNMGTYGKYGYGLIVYDVSDLIVAGENTFTLEKENGTTAVYPSTLVAFYNMPESSTYVTTYLYNGADLLSNANNFLGRLVASNSTLDIDSFDNIVGADLLVFAASAQAGEGSLVINGDLVADIWNGSSNSVDAYAIDLGKNPKASNEVSFVATGSTILALQQFIVVEYNVPSAEASLVSEYSNVAFAGTNNVLQFNLTNNGALNTSYIVDFYIDGKKVNSTQIALNSGESFGQYFIDDTIRPVDASTVNGAANAKVNYTVLVSDKDTGLILDEVTLTPSVLYNGNLGKDLAHPPEEIVLFDTITVNGDVIIDTLDDSTYLGAKTTGRTDEWNLTVPSDADFEVAYLYVAYNWDKTASGMPEWNTTFNGVNVTPVAHYRDQSNMGTYGKYGYGLYIYDVSDLIKAGLNTFTLGKENGTTAVYPSTLVALYNVNESNVLTTVSLFNGADLLSNANNFLNRTVASNNVLELDFTVFDEILSSQLYVFAASAQAGEGNLIVNNETFTNVWNGTSNSVDAYIVDLGNDPSLSNDVSFVATGSTILALEQFVVVKSKYQTSSDLQKLIDAAEPGSTLDLGDNVFQDVANVVIDKNLTIKGGSIMGKAGETIFVIPAKSANGPDEVNITGVDFIVEDANVIVQATADNGSSPTSIDTPNIRISDNFIDMIDGSVVPESVTVLKLDSERGVLAPTGELKVTDNAIAAGIKPFEFDVTGVSNGSDTNIPEGGNIPAKQASVIHYQDMETTAVNSKIEGRVGKYFEVNLTDTNGNPLANKFVQIGFNGVVYNRTTNETGGVKLQINLGYKGTYTFAISYLGDDYYNGSFVVSKIKVSTQNTKLTTAAKTYKASAKTKTLTATLKSSVYNKPINGKKVTFTVNGKSYSATTNAKGVATVKVSLSTKKTYSFTAKFAGDDMYTKSSVTGKVTIK

SEQ ID NO: 16 - protein, 1094 aa, Methanobrevibacter ruminantium
MKVLKIAIIMLILIISLGAVSATENFNNDLSDNGLNDNTLSDNSLNENTLSDNTLSDKSLSESTIIQNDHDNLKDTNNNDNNKALKDPAKTFTDLQMEIINASDLLELTDDYKYNNETDNITLTISKSNFVINGNGHTIDGDNQCGIFQINGTNITLKNLNIINANSTKDSALLLNPGSELETNNVTFINDSSDKRVIFAFGAKYTSNNDKFIDCTSLNDGVINSYLGEITINNGYFESSKPLDWAFVNSLGNSSIYVLNTTFANTTSKYATAIKGDRETVIHDSKFINLYANLTAGAIGLKRIEEAEIDNCTFINVSSQKNGGAIFLDIYSDSEDVPIMISRSSFVNCYSEFGGAILSLGGKITLEEDNFTNNGAFFDGGAIYSSFSQLTISQTIFDNNSVELDDDRGSFGGAIFSDISALIILNCSFSNNNAQTGGALYTYDSGYYIANSTFKDNTNKESEFDDIFTDFDGEIATLENNSYSGEDSICLNNERYESVIAVSGMNFTLIENEINVTNPPRKFDLREWGWVTPVKNQGYMGSCWAFGTVGAIESSILRFLGLEMDISENNMQDSLLQYYRYGTLGAEEGGEYNLGPSYALSWFGVFPSEYDVYDELGKISAIIATDDSIHLQDAVFVPPLMNSTDKDKLKQSLLKYGALAVSYYAETDEPGLNENTSSQYSLKNDSNHRVLLVGWDDDYSKDNFYMTPPGDGAWIIKNSWGEELGDKGYYYISYYDASFATLVPSVGFPIMNTVIYNKNYQYDIGGTLEFTDMGNEYVNEFEALEDDFIAAVGTYFIDAGVDYNIEIYVNDELKYSQDGTSPFFGFHTIQLDSYVPIKEGDEFDVKITSDCIPILESGRQHYIENKSAANLNGEWVDLTSDGKVCAIKVYTTDEDKKKESSRINTRIDCKNMTTTAVASEDGRIGEYFQVTLKDENGTALANKPIKIGFNGRVYDRTTDENGSAKLQINLAYKGTYTFAIGFLGDEEYLGAFEVAKITVKVQTPKLTAPNKSYKVSAKTKSLTASFKTANGKAVSGKKISFTVNGKTYSAKTNSKGTATVNVSLNKKGTYSFTVKFAGDDTFATSSAKAKLTLK

SEQ ID NO: 17 - protein, 1325 aa, Methanobrevibacter ruminantium
MRLRYFAIISLILLIFLVPVSFASETNLDSIELNDLADSSTEIDDSTDLNQDYSSNQDLSLNQNSDSNLSNEQELYSNKLSENSLDSNSQSSNDLSNSLYLSSNGVRLADLNSSFAQFNTSLNDSNTIYVNSSYIGSDEFGTQSNPYKTVLAGINAATTDLNNVYIANGVYNINTTITVLKSINIIGESLNVILNASNENNILSVKGSSVEVSIFNLTFRNGYANKGGAIYVDKSSLNIIGSLFDSNIAYVTSDNGYGGAIYNNAGFLKLYNTTFKNNKVVAAYNIVSEGFGGAIYNELGEMTVLNSKFYNNSIDIRNISKSSYGAGGAIFNRAGFVTIFNSSISNNSIYTNYSLGGAISIWASRNVYIINSTINDNIISGSYGFASVISNKGTLLQIENSTISNNNINASSVENSTIYNINGNFNLINSKMENNKIKTIKTNLLMCLEDQLIVNSSFNLANELKGLNMTSLPSHYDLREEGLVTAVKNQGSSGACWAFAFYSAMESYLLKVENISYDFSENNMKNCMGDGSENSTDWDDGGAYVVALAYLLRWSGAINETDDPFNARSKVSPTNLTRVKYLTDALYIPLRLGALDNDQIKTAILKYGAIFVPVYSNIIKANSKSGYSDIQYICNHAVAIVGWDDNYSASNFKDTPPGDGAFIIKNSWGTSGGEQGYYYISYYDASFAASIETSAAVAVTNVVNTTGEYRNNYYYDTFGNTFETIGYNSDTIWFANQFTAISDNPLNAFGLYTYGDSTYTVNITVNNKSVYTSSGKIVGAGFHTIKLSRYVPLTKGDTFRIIVKLTTPSTLFPLAVETNYSGFTPRAKSDYNQSFISPDGKTWYDLRNSSNNRAVKFYEDMYFYTLKNASVCLKAYTAFADELELNLSSNSPIYYTGDTIKLNLTVTNRGDLASNSSIAVPLDKSYSIVSYKISENNGNKSYDIHYNGSSFNMASGIWSIPYLENEESVSLILSLKMNSNNDVNIKVSANSSSCSVKDNVYANISLKYKIPSKFANIPSINTTARSYGLLNFTLLDINNKPLANKNVNLLLLKLDDEEDEDLSLNDTNLYYSDSSISNASVISNLTLKTNGNGIVQYKLNLTLGEYLFKLAFDEDKNYQASDYNYSLNITKRKSTKILCKDMVTYSVVAEVDGRSGEYFNVTLTDCDGYAMADKFIQIGFNGRIYNRTTDSEGKARLQINLKNPNAYTFAICFLSDDDYYASFEVAKITVNKKKMSLNVPNKAYKASEKSKILTATLIENNKKTVANKLLTFTVDGKTYSAKTNSAGVASVKVSLSSKKIYSFTVKFAGDDCYGSATKSAKVIIK

SEQ ID NO: 18 - protein, 296 aa, Methanobrevibacter ruminantium
MVNYDKVEDTFFESFDGMYIRALITAEDELTVKEAAYDATATPSAVIGRVEAGVESFVSGDKTPDGRPGAIVQFWLTDDLAKFEKELSYRIRQDILVKPFTRVFSITENPVGSIPMMESVGHCGDGYEWEIEEYGRKMINVPIAVPDFQIESELAYAEGIMGGNFWYMCSTKEAVLKAGRIIIDTIMEVDGVCTPFGICSAASKPETNFPEIGPSTNHPYCPSLRERLGKESKVPEGVNYIPEIVINAVSQEAMNLAIKKAVDAIIDIGGVERISAGNFEGQLGEHKTNLLDILKE

SEQ ID NO: 19 - protein, 310 aa, Methanobrevibacter ruminantium
MFRFDKEQLVVDIAGVKMGGQPGEYPTVLAGTIFYGGHKIISDEKAGDFDKDAAEGLIKTMEEMSDVTGNPCVVQTFGATAEAMVKYLEFVGDICDKPFLIDSTAAAAKIAGVEYVQEAGLAERAVYNSLSMAAEAGEIEAVANSDIDASILLGFNPMTPGVPGKLEIWETGGSVIDEGILEMAERCGITKPWMDVAVTPLGQGAGPAVRTSYAVKAKWGYPVGSGIHNVPSAWDWLRQYKKEHKEAWPVCDIGSNIVQQMAGGDFVLFGPIENSRLAFPACGMADIMIAEAARDIGTEPIEAHPLNLLL

SEQ ID NO: 20 - protein, 83 aa, Methanobrevibacter ruminantium
MSEEESVPQIIVSTDDMAAAINKLDEAEEKVEFAVGEYFQRLGQQNGRDIGILYGIILGLVILIVSIEFGLVSAMSTMLTSLV

SEQ ID NO: 21 - protein, 68 aa, Methanobrevibacter ruminantium
MVRFSNKPNTRGIRNASNNVEYRAKLLGREGRLFAGVISTRFSGMAIGIGLALALAVVIPYLAKLCGL

SEQ ID NO: 22 - protein, 245 aa, Methanobrevibacter ruminantium
MADKKPAADNWPVVSGDYIVGDPESPVAVTTLASHNEDIPAAAGAAIAGPCKTENLGIEKVVANIISNPNIRFLILCGAEVQGHITGQSIQALHENGCDPEKKKITGATGAIPFVENIPMEGVERFQQQVELVDLIDNEDGGAITAKVKECIEKDPGAFEEDAMVIEVKEGDDDEDEGEEIRPISAETALLEARIRNIDTQVKLVGAVQRNMAGNYSGKVQGIMIGLIFTLVIGFLLLMAPLLGA

SEQ ID NO: 23 - protein, 106 aa, Methanobrevibacter ruminantium
MVLPLIQFIPELNLNLDPETGLLGAGGGDLIILSMDEINGEIAKVEAAADELMNSLDPNSAPLGSFPGREGNFVIAGTLTNMVYGFIIGMFLIMAAMPILTAMGVL

SEQ ID NO: 24 - protein, 233 aa, Methanobrevibacter ruminantium; identical to SEQ ID NO: 10

SEQ ID NO: 25 - protein, 233 aa, Methanobrevibacter ruminantium; identical to SEQ ID NO: 11

SEQ ID NO: 26 - protein, 290 aa, Methanobrevibacter ruminantium; identical to SEQ ID NO: 12

SEQ ID NO: 27 - protein, 550 aa, Methanobrevibacter ruminantium
MADKKFLDAMTKKFKEAPEEKTTTFYNMGGWTQSERKTEFVNEGKAIAEARGIPMYNPDIGNPLGQRALMSYQLSGTDTFVEGDDLHFINNAAMQQAWDDIRKTVIVGLNTAHNVLEKRLGMEVTPETITNYLEVVNHAMPGAAAVQEHMVETNPLLVDDSYVKVFTGDDDLAAEIDPAFVLDINKEFPEEQAEALKAEVGGAIWQIVRVPSVVGRVCDGGTTSRWSAMQIGMSMISAYGQCAGEGATGDFAYASKHAEVIGMGTYLPIRRARAGNELGGVPFGFMADICQATRVTDDPVESALEVVALGAALYDQIWLGSYMSGGVGFTQYATAAYTDNVLDDFSYFGKDYVEDKYGDLCSAPNDMDTVLDVGSAVTFYSLEQYEEYPALLETHFGGSQRAAVVSAASGISTAFATGNAQTGLSAWYLAQYLHKEQHSRLGFYGYDLQDQCGAANVFAIRNDEGLPLELRGPNYPNYAMNVGHQGEYAGIAQAPHSARGDAFAVNPLVKIAFADKNLPFDFTKVRAEFAKGALREFEPAGERSIIIPAK

SEQ ID NO: 28 - protein, 219 aa, Methanobrevibacter ruminantium
MAQYYPGTSQVAENRRKFTNPDVELEVLREISDEDVVKLLGHRAPGEEYKSVHPPLDELDEPDDIIREIVEPIDGAKAGDRVRYIQFVDSMYFAPAQPFLRARSYVYRYRGIDTGTLSGRQIIEARERDVERISKEILENEYFDTARTGIRGAGVHGHSLRLDENGLMFDMLRRQVLNKETGNVEMVKDQIGRELDEPVVLGEPLDEETLRAKNHNLQM

SEQ ID NO: 29 - protein, 198 aa, Methanobrevibacter ruminantium
MIGRCTHLVDCRETRGLGEGGGIAQRGTFAECGSDVLAVAMSPGRRHITKPVCEITFGLREANLLTSTMILDAGSGVPHDAPAGGAGNAFGLTDKEVEQMQKFKVIVVHLGGVRNHITYKARLILRNVNKPCVIICEYPVDFEDFAKIGVKTAKVMPDEVKTEGKIMNIVSGVIRGQTVSQEKLDEIIRKVRLTLGDA

SEQ ID NO: 30 - protein, 151 aa, Methanobrevibacter ruminantium
MDIEIFPHRILGTDTTEKVLNDLESLDSVKRTVIQGPRLPPQDEIDRIYGDRRIIVVNGEEVELKVKTGRIFVELYDESGIEEIRAICDKHIDTGFDINTSKAQYIRKQKTVTDGLKYGENTEIPEELIGIADTRSKFNEHVSILRKDGLE

SEQ ID NO: 31 - protein, 443 aa, Methanobrevibacter ruminantium
MAKFDDKVDLYDDRGSLVESDVPIEALSPLRNPAIKNIISGVKRTVAVNLEGIEKSLKTASVGGAKSKILGREMDLDIVAQADSINASLKEMLQVTEDDDTKCEILSGGKRILVQIPTIRLDSSAEYSVATLATATALTQAIIKEFDVSMYDANMVKAAILGRYPQSVEYMGSNLKTMLDVPQKLEGPGYSLRNIKANDFVAATLKNTLQATALASIFEQTAMFEMGDAVGAYERMHLLGLAYQGLNADNMVLGLVQDNAKEGTVGSIVQDTIAKAEADGVIAVEKELTDYNMYATNDAAKWNAYAAAGCTAAIMVNVGAARAAQGIPSTILYFNDNIEFATGLPGIDFGRAEGVAVGFSFFSHSIYGGGGPGLFNGNHVVTRHSKGFTIPCVAAGMALDAGTQLFSPEATSGLIKEVYSEIDEFREPLKYVALAAAEIKGDI

SEQ ID NO: 32 - protein, 295 aa, Methanobrevibacter ruminantium
MEINGVEIKETYAEGFGIKVTRILVTAATAKLAKIAATEATGYATSVIGCPAEAGIDCFVPSECTPDGRPGYAIMICHASKKALDHELMERIGMCVLTAPTAAAFNLLESEDELKTAFKLKYFGDGFEKDCCIDGRKVHSIPIMSGDFIVESTFGFKAGVAGGNFFILAKDQITGVKAAQMAVAAIRNIPGTITPFPGGMVASGSKVGSNKYSFLPASTNEKMCVTLKDQVDSDIREDAEGVFEIVIDGLDEESVKKAMKAGIVAACSVDGVLEISAGNFDGKLGAYILNLHDLF

SEQ ID NO: 33 - protein, 282 aa, Methanobrevibacter ruminantium
MCDIMVVKIGIVKSGNIGTSPVLDLLLDERADRPNIDVRVFGSGAKMNPEQVEDVVPKLDQFDPDFCIFISPNPGAPGPARARELLSEKDLPAIIIGDAPGKGKKDEMDEQGLGYIIVMSDPMIGAKREWLDPTEMAIFNADILKVLAETGALRLVQKTLDAVIAAADAGEEIELPKLIVTAEKAVEAAGFANPYAKAKAIAAYEMAGAVAGLDMKGCFMTKGFENFIPLVAAAHEIASAAAKLAQEAREIEKSNDTVLRTPHMKEGNLGCKVDLISKPVDK

SEQ ID NO: 34 - protein, 149 aa, Methanobrevibacter ruminantium
MPKHIVSGLKYLESVELRKRGLSQKEISSEIGVDRSTISHYLNGRNISADSIELAKVILELNPKDFILIARVLFGDYNEIRQLISIFNMNHYDPQIDDGCIGCGLCVDLCEVKSISLDSLKAKINPRYCCGCLMCVEDCPTNSIKILEV

SEQ ID NO: 35 - protein, 367 aa, Methanobrevibacter ruminantium
MVKNIKETEGKNFCIKRSLGEERVLSFKDHVCVGCGLCEATCPVEAISLDEVAPIERKYVDTYFSGHEKIAQNYALFTNDNEIKAKLDICEDKCVLCGLCSGVCPAGALELAIDGVSIKENEAYPHLVTSAEIDEDKCLFCKKCEAACPRESITIDRKLPNRADLVTGEIEVDEEECIYCGACAELCPAEAIVVDKATGEESIVIDKEKCVYCLVCKKACPVDAIKAVCRSCSYGEYDLDPAKAAITGNAIIDSETCIKCGWCEGVCPADAATVKQAFKGTLEIDEEKCGTCGACIDVCPCNVLSFPKSTGPGDRGTHLVKEEDYCIHCGACAKVCPNEALTVTRTDVDYTPTSSKSWIAAFEALKN

SEQ ID NO: 36 - protein, 76 aa, Methanobrevibacter ruminantium
MELKVDQDKCLGCGVCVIACPVNASISPENAGGHGSKTTETIMMVENGFIKLFSVDKCDKCGTCQMFCPTEAIWLE

SEQ ID NO: 37 - protein, 178 aa, Methanobrevibacter ruminantium
MHYANTYLERPVVGDLENVAQEGTTKVLKCMLNTGSDIYQGACKKRGSTLKEEYKNASGTCYMDPRDMVKLGVKNWDTVLVKTDYGEVVLNAAKSRDAPHEGTIFVCKGPWANTIVSHETYCCSDPTYKGIHATVEKTDRKVLLMADLMRWAYKKYVDEEDDDVIENMESLGERPVYN

SEQ ID NO: 38 - protein, 463 aa, Methanobrevibacter ruminantium
MTYEPPVTDYDYIVENCTCAFCGCNCDDLDFLVKNGHVVAVRHACRLGASKVMEDMDQRLLVPMVRNEEGVLEEVDWDTALDTAAEYIANSIRPVFYGWSETSTECMKEGVELGEYIGAVLDNQATICHGPSLQAMQNAGYPIQTLGEVKNRADVIAYSGSNAMNSHPRHLARYAAFPRGYFRQRGRFDRTVITMDPKFSDTAKMSDKWIGFEQNGDYGFYNALRAVLKGKKLQSESVSGIPAEDIYELAAEMEAAEFGVLFFGLGLTHTLGKQRNIDIAIKLVQDLNTNSKWGLTPMRGHFNVNGFNIFMAYETGWAFGVDFCRGYGRYMMGETNTIDLLVRKEPDCFMVIAADPGAHFPNGANQHLADIPVIQIDIHWGPSTELADVVLPGSFISVECGGTSYRMDGVPIWMKKAIDKPETCRDDEWIVRELKERVMKLREEPNVADEYVPNEGLACLLDK

SEQ ID NO: 39 - protein, 572 aa, Methanobrevibacter ruminantium
MEYILKNGIVYDPANEVNGEKMDICFKDGKIVEDVSADAEVLDVTDKIVMPAGVDPHAHVAGPKLVVGRLYRPEDERRGVAQKTKTTRAEAGFSIPSCPTTGYRYSRMGYGTVCEAAMPPLEAKHTHEEINTIPNIDINPLPLFGNNWFVMEYARENRIDDLAAFIAAMLRVSKGYGVKIVNPCGSEAWGWGMNVHGYDDKAPYFDVTSREVVRALAKANEKLGLPHSIHIHPNDLGHPGNVPTTIATLDSIKDIAKSTKPSASVRDQTIHCTHLQFHSYTGNSWKDAASGAEECADFINKNPYVTCDVGQVTFDETTTMTADAPMEYDLFKISGLKWANKDIECETAAGIIPCIYSPKTPVSTLQWAIGLELFLHIENPWQVCLTTDHPNAGPFIRYPKIISWLMSAPKRMEMIDNGEVHKWASKRTGLAGLEREYDFYEIATISRAAPARIHGFADRGALTPGYNADIAVYDINPNDFDPSRDPEGVEKAFSNAYYTIKDGQIVVKDGDIVSTKQSHTIWTNVIGYEEEEKQIIDSIMPFFTQYYSVKWENYQVHDHYVPNPTVVDVEAK

SEQ ID NO: 40 - protein, 288 aa, Methanobrevibacter ruminantium
MKTITFDQKKTSSIALEFDELITDNIYAWTEEDFAEYKVPIGNSRFPITDYFDITVEGEAESPAEVKMILNGDCNRVKYIGCKMSAGEVVVNGDADLHVGAEMSGGIVTVFGNVAAHAGREMKGGKLEIMGNTKEFCGASYIGEWRGMSGGEIIIHGNAGKQCGECLVGGKIHVLGDCDILAGIHMTKGTIEIDGNVNRWPGGQMKNGNIVIHGKVGRLLEGFVEQGIVTDPELDGVTYPGRYIEYKGDIALNGKGTLLIDAEKNRDRLSTWIEEDDEYNAIREYRDQ

SEQ ID NO: 41 - protein, 318 aa, Methanobrevibacter ruminantium
MKFGIEFVPQIPLDELVRLVKIAEDVGFEYAWITDHYNNKNVYETLALIAANTETIKMGPGVTNPYVRSPAISASAIATIDEISNGRATFGIGPGDKATFDALGIAWEKPVSTIKAAIADITTLLDGGKTEAGAALGGAKKVQDAIPIYMGAQGPKMLETAGEIADGVLINASNPKDYEAAMPMIKKGIGDQDKDFDVAAYTATSIGTDSEAAKNAAKIVVAFIAAGSPPPVIARHGLPEGFNEQMGEFLAQGNFGGAIGAVTPEALDAFSVCGTPDEFIPKIEALADMGVTQYVAGSPVGKNVEESIKLLGDVIASF

SEQ ID NO: 42 - protein, 338 aa, Methanobrevibacter ruminantium
MKVAILGAGCYRTHAASGITNFSRACEVADATGKENISMTHSTIEMGAELLELAGVDEVVVADPVFDGEFTVVEDFDYAEVIAAHKAGNPEDVMPAIRAKVGELAETVPKPANGAIHFTHPEDLGMKCTTDDREAVADADWIMTWLPEGGMQPAIIEKFADVIKDGAIVTSACTIPTPGLNQIFEDLGKNVNVASYHPGAVPEMKGQVYIAEGFADQAAIDTLKDLGAKARGSAFTLPANMVGPVCDMCSAVTAITYAGLLSYRDTVTQILGAPAGFAQMMANEALTNVTKLMADEGIDKMDDALNPGALLGTADSMNFGPLSEIVPTILESLEKRSK

SEQ ID NO: 43 - protein, 193 aa, Methanobrevibacter ruminantium
MADKKPTAENWPVVSGDYIVGDPESPVAVTTLASHNEDIPAAAGAAIAGPCKTENLGIEKVVANIISNPNIRFLILCGAEVQGHITGQSFKALYENGCDPEKKKITGATGAIPFVENIPMEGVERFQQQLELVDMIDNEDGGAITAKVKECIEKDPGAFEEDSLVIKIDEERYSKKSSFVESSSESEKIESEA

SEQ ID NO: 44 - protein, 321 aa, Methanobrevibacter ruminantium
MVSVNLEAKKTVDVMIEKADDLNIAVSKLENGATVIDCGVNVAGSFKAGELYTKVCLGGLADVGISIPGDLSEKFALPSVKIKTDFPAISTLGAQKAGWSVSVGDFFALGSGPARALSLKPAETYEEIDYKDEADLAILTLEADVLPGEDVAQYIADECGVDVANVFLLVAPTASLVGSIQIAGRVVENGTYKMLEFLKFDVKKVVHAAGIAPIAPIDPDGLKAMGKTNDAVLFGGRTYYYVKSEEGDDIAAVAAQLPSSAADGYGKPFFDVFKDAGFDFYQIDKGMFAPAEVVINDLTTGKLYKEGFVNAELLKKSFGIE

SEQ ID NO: 45 - protein, 241 aa, Methanobrevibacter ruminantium
MVLALSIILLSSIAAASAEDYSLTNAKIDMVIQDDGLVFVDEAITYHFYKTMNGVYRYIPINNFNMEDFAVDVDGAYYELEGNDDDSQIEAKVYLYKDKDKTEKIDPGTDVTVHYKYYMSDLLDVKGDNAVLNYYLLGEDWEVDLEEIEANVHFPEKKELDYELVPSGSAEGKWSGDTLTITGENINAGDGLALIVEIPLDEFASGFSNAVHNDTDDDDDIDNDIDNDKDDLKDLTKAKQI

SEQ ID NO: 46 - protein, 186 aa, Methanobrevibacter ruminantium
MSTFILVIIILGIILIIAGIIVALYNGLVTARNKVKNAWAQIDVQLNRRADLIPNLVETVKGYAGHEKSVFEDVTAARAGLMNANGVKEIGEANNQLTNTLKTLFAVAENYPELKANENFKELQAQLAESEDKIAYSRQFYNDTVLMYNNKCQTFPSNLIAGLFGFKEADFFEAAGEARSVPKVEF

SEQ ID NO: 47 - protein, 168 aa, Methanobrevibacter ruminantium
MDNKKIFVIVALALLAIVAVGSVSALDLGFLGGNDDQDTAAEDSDAKTTTIKGIEFNIPDGYVKAENYTLDGETRSSGSIDYKVYQEGYEKGATDAILFLIGDYPTDLTDDMLEQMNLGEPKTINGHDGYITTSNEGGDTFTVFFYAEDGDLVTVTVTDDTLLEEIIK

SEQ ID NO: 48 - protein, 154 aa, Methanobrevibacter ruminantium
MNNKKIFAIAALAIIAIVAVGSVSAFDLNFFGGDDKQTTTLGGIEFNIPEGYEIVDNYTIVNETLHDGDDEYIVNSQYYENDDGDSLELYTSDYQDDMEDYILKILTKGDEKTINGRKGYINSEDGFTMFSFVDDGNLGFVTVSDESILEEVVK

SEQ ID NO: 49 - protein, 155 aa, Methanobrevibacter ruminantium
MNAKKLTILAALAILAIVAVGSVSAFDLNFLGGDDSSTTTVGGIEFNIPEGYEINDTYTIENQTRTSSGGNEYIVNQEGYGNSDGEELLFLVGHYDTDITNEMLSAMKVGDEKTINGQEGFITSDDVYTVFSFAKDGELVTVTVSDESALESIIK

SEQ ID NO: 50 - protein, 1024 aa, Methanobrevibacter ruminantium
MICCVLLTFSTVSAIDMDGNLTASVNHLDGSHSDQSAFISQSESSKTNLNANNNLRVSSGDYDCVETMNELSNLDSKDSKDNNLSKDKTSLKSDLNSIDSDEYSLKSSLSSINSSKKSSYEDGDNEYENLEDSLDSKNKNSLSSNALGAGTSTFGDLQTMINNAQEGSTINLDGKTFIGNGSFITIKKAITINGGSATNLARFDARNLSYIFKISASNVHIKNCYFSYSTNCSVYFFGNGSSIDNCHFDYNYKHLWVAVNIKYFSLTNCNFTNGKTDMGSTAYVVADNATVKNCNFINNEASGTEQCYGAALQIGASSSGINEGYVVNCTFINNRVITTHSYSHAGALCFRPGIKVYNSTFINNYCNRMGGATTLHSDGEIMNCTFINNSAGEYGGAISTGLMADNISVNITGCTFINNYAPMGGAILIKGNNVKVTNSTFKENKARENDGGAVYILGNDALILNSTFQSNYAKNVGAGILINGSYVTVLNSSFARNNASYGAGIYVIGSNANLFSSNFTNHNVKNGSVYIKGIGAYVYNCNFASNTGENGAALYIEGSNTTLILSNFTNNNVTKDGGAIYVVGSNAKLMASNFLYNNAIPSESDIKSGLGGAVYIKGNSNTIDSSSFKYNTARNGSAIYTDGKNMNLSNDNFDRNQAWSYVLDSVIKPSSSYFNRSDILINLTLIGGNNIANAIYNTASVNDIYFYNVSYISSKGKKVTTSNEIHPVNGASNSQNGALLYQDDREDNQLVNVIVYKDPNSKSTSLSAINKNDIILNKTFTTGILGNVSLNLSSSVGKAIAPGNYLLYAKHTEDDYYKEIDEDNQFEILPLVDVAVDIVSSKDIVEYNRTNKFTVKVINNGPNNATDVQVSAVLPKGLILVSSSPSVGTYNSSTGIWTIGNLNSGVNQTLAINTRANTTGAVNYPVSVSSYEKDTNEANNKDNQSIKIPECDLLIDIASSNHSPKYSDIVNWTVTVKNNGPDDASKVVVSLGNLSGNELIYQKSTNANFNISTQTLELSKLASG

SEQ ID NO: 51 - protein, 105 aa, Methanobrevibacter ruminantium
MIIAIIFMYNRVRNKRSTPATFALWVVVWMVVLFFAFAPKISDPLAGFFGFSRGLDLLIIAGFAVIAYAGFRFYIKIDNLNQNMTDLVREIAIRNEIQLDEENDE

SEQ ID NO: 52 - protein, 1024 aa, Methanobrevibacter ruminantium
MNKVQLSSILALVLILFLSLAVVSANDDILNINVTDTQDSVIDNSNGISDYFSSDNGIINDDGLSSDDETAGSQLLNDSEDLDSSDDLAKDSDLEDSKETSKTQDNSQKNEDSKTRLSDSSIIRITDSSYSSYFDLSKDGAIREGTIKDGDTLLIGNVSGKIFSITKNINILPISDGDTMSNCLIRLIEGSSGTSLSNLRIVNRNEKVGSFYLCGIHIINSAGHDIVNLTINNSQMKCYGIIMSNASNNRIINSTIITGQATAIPMTGSSNNLFYGNYIETYNTNMIYYCMYGNGDFYPREDLEKSHDNIIANNYFTSRNGTYDSYCYSVCLMAEAGGSGTVIANNTFNNTFRPITVSTPDTLVINNTILNVGGEAGIIVDGNNVTIMNNNISTKRLEGFQWNKEGDVVGIFTYGSNTRIIGNSIDTVGTNGIRSSGDATFISGNTINTESSACINLTKSNAVVEDNALNGIGSSAVRIYTSKLVENTTIRNNNISSDSEGIVLKGKIDYSLVCGNIIEISNPEDAIIVGKYTNRNPLVPQHYAIFNNTINGIVVNLTDISEIERNDTDSGLNNTNTSDSGNNGTGNTGNGTNITDVNGTDINGTDVNGTNITDINGTDVNGTNVTDVNGTDVNGTDVNGTDINGTGNATIPVNITKLSTSITVYNTTVLRGDYLDAYLKDQYGNPISGVSIDFHFKDKVYAKTTDSEGKASLHFDAIPDNYTMNISFTGNNYYLSSNITIDISVIPVSYYLNESNFYEYFGEDGYLKGDYEYADLIFQGDFRNKRIVLNQPLRIISDSAVLYDSIIKIESDKVVVDGFTIVNRNPGNKQDNHRFAILLDYVRDVSVINNKIKLDSYDSGYGIYLSETQDSTVSNNSIDVKADKLTFGIILYDSKDNLIQDNIIKVNGTDDPHQYESTIQVDTSISVDDYEAEGMIIPEVYKTYGIILFYSSSNDIGYNVINATSGLKKYYTAVKESTNSIVGVDLYYDSNYNKVHHNNVVVSAKDPYLYGLGVLGAETGKRDQ

SEQ ID NO: 53 - protein, 285 aa, Methanobrevibacter ruminantium
MRKEIISILVIAIIAISVIPTAFSATDNGIVITYGETTYNNQNYKSIVDNYFASKGYGSSNVQGEVITAADVNAISSGISGKTYNSNQIVSCALVDMTQNNEITVEVDNSITTITPQMYASALKSAGITSGHVYVSTPVTATGESALAGIMNCYEEVTDVEIPENVKQAANDQIYTEAAIVENNDDVSSEELSKLVDDVKEEVQEKNITDHDTIVTIINDYSTTYNINISDSDIENLADTIQQLQEVQDDANSYKEQLDDAVNNTTSGFSIDGILNAILSIFNFS

SEQ ID NO: 54 - protein, 136 aa, Methanobrevibacter ruminantium
MNKKRFKLLLTIFIAFALINTCFILNDNLSAADNAPKGYSNYYIRGVCFNVPDSYKLVDEGWDDVNRLSYAHFKKGNNFLNISLDKHSTKFNKNLLDGFSSFTINGINLNKKTISHVTGFYAKKNGVKAFCLCNRG

SEQ ID NO: 55 - protein, 130 aa, Methanobrevibacter ruminantium
MMVILLITLLSVPILSLTIDYSNDVINSISTKNELSKITDSIDFCYYSGKGSKKVVLLDFNQDFSVRFTNNGQKGIAYADLELSDNNHKEISSEYDYIGLNTNIQFSKGFNKILVEWDEDTGLIRLSKLN

SEQ ID NO: 56 - protein, 1024 aa, Methanobrevibacter ruminantium
MISLSSVSAINTNDSSIQDNGDLSIQDSIDEISQFDESEQLNKINKDSPESNFNQELSNDSKDISADSNQDLMGFENYDFKYNTKSSYSNALKDSNVINVTGSTFQDIQDAIDRANDGDILYLKSYKFHGNGTAISINKPLTIIGSYEANNKSHYLDAYLKSRILYIDSDDVTLINIHFDYGGNIDNNGNGGAIYLDGTNCAIVNCSFKGNHAWLGGAIFQSNNSNDLYVGGCKFVENNAQIGAGITTCGFNCLVSNCSFENNSAVTAGAIMTDTQKNGDMTFFRLENSTFINNNATGGGGAINFDGYYQSVYNCKFIDNYAKNSGGAIYGSLKPFDVSLCQFYNNYANTGGAIRGTANYNVSDCRFINNSAHHAGAVFLHSYSNVIDSYFENNYAEANGGAICTDSNTVGVIIKGSTLIGNNATTGSAIMMVSSRSIIENCNFSGNIGKSEGAIYSIHDCNISHCIFDSNQAEKGGAFYIYRGNNSNIDNCRFINNSANSSGGAIYWYVNKGKISNSYFEENQARYGSAIYCSNVEADSGFIITDCDFINNHPKEDGSNTKGGAIYLYDQLKCIIVANSTFEYNYASRGGAIYVEGDVNLIANSTFKYNKADIFSLSAYNDNANLIVTLRGYENYMNAIYAEKTVDFHNVTYWDGEFVTGDYPIKRNLEAGINIILDCRGNGHSLNVTKMTNSMGEVIFDEMRTLPSGTYAYQVSVPDNSYYTAKKLKPDIFNVPYLCENILGIDVADISYDQYPVVNITANYTGNYTVYIANSSYDVTFTDQDVERGRVLGYNITITDEDVVKGEKLIVIPHLFDIKDGYGAYVQLRAIDQENVELVYIQNRTSFNVYKAASALEAEGAVAVNGSDIELNYMAQNGTVTIESIKKDGSLLENGTDYNFTVNDDKIIITGLDAGHYIANLTLIVDDYHNSSSIDVSIDVLIKTSIDVADSISIAETESSLINATLSPEEAGLLNYQSDNETVAVIDNDGRITGILKGNATIFVSYAGNEDYSPSNATVKINVY

SEQ ID NO: 57 - protein, 1024 aa, Methanobrevibacter ruminantium
MVSLSSVSAASDLIQDYEDLTIQNSYDDLIIQDSFNEDLIQDSSNTELKTQDSSIDNLKETINQTESIDDTLTNQDLSSLQDSSKENIKDSNLKSSRLGKSITVKGNTFQSIQSAIDGAEAGDTIILSENMFKGDNYYGLGEQIYINKSLTIMGSSQFGSQYIILNALHSSRIFNITADNVTISNIQFTNGYVVGEPGGAIYWFGNNGKIINSYFSLNCANSSMEWDIEGGAIYFGLKFKNQYIENCLFKYNSAYDGGALYTCSQNTTISKCTFDSNFGISNNAGGMANGAALSFSAKDVYVIDSTFLNNDAPEGWGGAVYIYKHGYEPYFFNCSFKNNSAAFGGAICWLTDGGTFLNCTFENNHATGGDAIPHGGAIYKIGRNGGNIINSTFTRNYATTGSAIYLNAYLNIDNCTFTDNQADSEGAIYIITDNVTIRNCLFDKNYAYNYGAAIFSWDHDNIKVENSRFIENHARNEGGAIYFLGKNCQIYGCLFEGNRVSNFYSFGGAVFMEISGEDTSILDCSFKNNSALYKGGALYISYGSSEKIAIINSSFEDNSASNGGAIQADWNLSLIANSSFEDNSASYGGAIQVFGSVDLIANSSFEDNSASYGGAIHVFRSIGLIANSTFKNNYANSLEINQSKESYGRVFTFKGKENYINAIYTEDYSLNFENVTYWDGSFVTSGSPIKSDCEAGIKIRIVLRQGVSAGPVVLNITKITNIKGEVVFNEYNGLSPGIYYYEAYHPKDSYYSESEKLSGMITVPKKATDNTLAISLDDSIYGEDLKVNVNTDVSGEYRIYIANSNYDAIFTDDDVAKGNVLAYDITVNENELKGNKWTILKNSLNVKNGYGAYIQFADLEDGENYINIHNRTSFNVYKAESSIDANETIAIEGDGAEVNYTIENGTASIDNIRRGSAILEEGTDYNFTVTPDKIIITGLDMGNYTVKLKTIVDSNYNPSTKEVFICILGRTAIDVQESVAIEKDKSYLLSPTLIPEDAGTLRYISNDESIVKVDSKGNLTAISE

SEQ ID NO: 58 - protein, 861 aa, Methanobrevibacter ruminantium
MNINLKKITFLCLVLVLIGLISFNSISANDLGTVLEDNDNNGLNDLNNDDFINSDVNSDSINKEAISNLKSLNSQDESTSSDSNNSASSNSNSSVASSSNSSASSNSANSNSSTSSNSANSNSSVSSNSTNSNSSASSNSTNSNSSASSNSTNSNANTNNSSSDASKTQTIKLSSQEESALNEFLNAIKTTTKGTIVLKNDLVLNQTISLNNNITIDGRNHSISSLDVTNMFKTFAKITLKNIVFTNYHEIENLRAILNSGELTVLNCQFNGFSYLTNGSAIYNSKKLTVQGTKFNNNYVNNSGGAIYSTGTLTINNSSFNKNHAGKNGGAIYSTLNLILNQSVFSNNSANESGGALYSKGSGLNIKYSRFNNNSASLNGGALYSSSNSTVISYSNFVSNFVEAYDKASNGGAAFIYYGSKIAYSNFTSNHCKTTLTNSSQKKSIQSMGGALFYYGGNHTLSFSNFNKNSVENDGGAVRIAKNVGKFTLNKCNFTNNNASYEDGGAISLATPNITISNSIFKNNFANEDGGAIDTFSLGSYKVNVLIKNCLFNSNTAFKAAGAIYLGVNTVQSIVNSNFTSNKATVAGAFYIESISVSISNCIFSSNKADNVSKKTIYNKQGKVVSHSGGAVFVKNGSTVTIKNSLFKSNKATSGGAITNHGKMVIDKCNFTSNSATNGGALYGGGKTSTIRNSIFYKNSATKTGGALFINEGNVNMKSSMIVSNTAKSYSVYSTVSITLNNNWWGNTLSIKDKSPKTLGLTNVKVSTWLHLKIRAKTTKLAKGKTTTLTIDLRYNNNDKLVSTAFNNPLTLTVSEGTLSSKKVNLKNGKATVKFKKTNSKTAVVKVKLLGKTARCTIKTK

SEQ ID NO: 59 - protein, 243 aa, Methanobrevibacter ruminantium
MNNQNKYSCIVLAGGMSRRMGQDKGSMIIYNKPMILHILERLNHKINDAVIVLNNAERISIYRNLLNQYADNDIEENFDYELSFIEDEVKSKGPISGVMTGLKNIKTDYALVLPCDSPFISGEYIESMFGILDENPLADAIIPFHIKSNKDKFKDNEEFNFKNADEMSLEMKIQNSEPLHSIYKKDNLNNIKSLLDDDSLYVKSFIRSLKSPVFIEVDNKVLFDDDFKNLNKQEDIDNLKFKK

SEQ ID NO: 60 - protein, 1024 aa, Methanobrevibacter ruminantium
MGFFDKLKNALESGNKSHDKRESQKNEAISDNPRGDSLSDNKNRNSLPDNQNRNSSDNNNVRNFKYLDDLIHSGQKDIVLDCDIVLADSEIESYKRGIDIGGSNITLDGNGHVVDGRNKAEIFKVSSKNLAIKNLRIENGYSELDSIIDVFSKGELHLSNCSFFKNSNESHRIFGDNLVCIGSIIRNMGELTIHHCHIRNNSSRGQGGTIKNTGTLNISDSIFEYNLSLEDGGAIFNEGLLKLSDSRFEFNHSNKRGGAIHNEFNGETIIENSSFDKNGGRKSANDISNRFNLVLKDMHSDLKIDNEWTVFIEKGKSFDIDNKGGIIEFAPLNNDEKSFTFLKELLDGNDSQIDLMHDIKLDIANDEQLYFPDGINFNRDNLIFNGNGHTIDALRMRNIFTLAGNDIIFRNVNLENGFSKLSNGAAISMKEGFLKIYEVEFRDNAAYNGGAISIKDASVSIDSSIFRHNAANAIKFETGGGAIYNENGSLSIIDTLFISNSSLWGEGGAILNKSGALSLNNCDFTDNRSVKNGNDISNYDSLRICKCSFESDKANNSNSDSGEITNSNLGSKINNSNSDSGEISIFNNNLSKLYDSNFNHSIIINKGLLKIDKDFPIKSAQIKNSGKLKAYNFNDKQIEGIDINNEDGGKLVFVIDGVEVLNTVEISQKWIEIKIFISSTFKDMHSERDYLITEVFPELSKWCKERRILLTEVDLRWGITREDSRSGNSINICLQYIDKCRPFFICFLGQRRGRIPEKGERKVTEETFINFPKVSNLVGHLSVTEMEIEHATTLPLFKLLENDFDNEHAKRALFFLRENPFEDVDLSPAQRDIYLNRKPEDDEKLSQLKDLIREKCIFFDYSCIWDENMELYELSSSKGGLTDFTCNGRPLSEVIIAEVKKQIENEFPDYKPVKTDDIFLDDAMLQNLEIMSISHDFVGKQKEIDYINEFIESDNERLLLVKGAEGIGKNTLLSRVHALLNEKGISSIMRISNATAKSNSSSNLSLSIGSEIGLFNGEEALYKG

SEQ ID NO: 61 - protein, 244 aa, Methanobrevibacter ruminantium
MEVEGDKMNFKEFEELINSGVKEISLNEDISLEDKTQAPIEIKTDGLVIDGKNHIIDGNNKLPILYIKASNITLKNIIFKNGFSEDYSGAITNYSNDLKVEHCQFIDNSTENAGDLYGGAIYNGENSKLTVEKSIFKENDSDFGGAIFIDSDSTVKINNSVFELNISEFDGGAIYNKGELIIDKSIFNQNMAFKGGAIFNENSLTINDSHFKNNKASDGNDIQTENEDISISNSLCEFINNDNY

SEQ ID NO: 62 - protein, 370 aa, Methanobrevibacter ruminantium
MNFTEFEELLGGEAKEISLYEDVILESDEDYRRGIELKRDGLVIDGKGHVIDAMERAKAFHIQGDNITIKNLKFKNAVSHKGNGGGAIENVGKELSIKNSHFFNNCSLGPLGGGAICSFEDMNINDCIFESNTSVRSDGGAIYLETFFKPNVTVIMKNCSFKNNYADGGFKDFGSNAGAIFNKNANLYLFDCNFEDNGVVSAYDSSSESIQNKNGIITMDNCCFNTRESHSIFNLGFLLINSSRFYHHPENLEIQGSIFNRGFVGLLYGERNQYKVELDGKVLDSSDIGDLINEYKKTYNLDTKEVGFIFKKNIIESINDLSSDNFNLEDFNLGDINLSDYKDDEYLMDLLKNKIDLIYSGDFEDSDESI

SEQ ID NO: 63 - protein, 136 aa, Methanobrevibacter ruminantium
MLYYRGAGWADWDLDNFGSRISYIDDFPFNILKALLSYFETGDEQSVEFNAEGWFYTFKFSSDVRVGERVIYESTIDFANDFICEIEERMGLWAFFPSRRTSDEDYYELVDLIVKIRTELLDKDLINKWIDIISQS

SEQ ID NO: 64 - protein, 585 aa, Methanobrevibacter ruminantium
MGDYMNTDYLKEFEELNHTTESLFDLGISGLLIILKDGTNLTSWSELSNPDDILYLSADFRCKENYTEFSNFKNAKVLILQNYVRPNFGVGSLFFKEADLITKLSTWHSLVAFYGINWDISSTDSLKNMFANCLSLEYAYFEDWDTSHIRNFWGMFVACCSLKAIDGMENWDLSSAENMESMFESCMSLEDISFLSDWDMSNVENIFEMFRDCYSLKDASCLNWKFKNLKNGDNLFANCRKLESFPSWYDDEFINQFGIRNQLNLIDDDSFFYKIAGGFDPQDIFIAVGYIRDEECLKRLLRDSSVHFYARRAALLNPNLNDTEILEEFADSKDYVERAYAIENPNFTNIGIIRRLANNDKSHLVRFKAENKLKELKSEGLEIIEDYPREFKQAFEGHDRERASLVLSQWRGYDSTDANFILAKVISDSSDEEIEFSETFEAYIISMEEKPQDPSLFNWFSSTAVECMEKRVDEDIGFSQLFNNMYKSHMNSTDYATAFLDFFQDILENDRVEKLNLLRGLVDSWDTDCPDDANMHCAYVILNIKKISKDELEDRIAKAKVCIPENLNSYPKLMAFMNAVLEADK

SEQ ID NO: 65 - protein, 169 aa, Methanobrevibacter ruminantium
MEDRKAKFIVYVVVCLLAFICSSTVFSMTGGLSDWIVSNVNTNEDANNNGYIDSSEGQYYSDSDGQYYSSSDSYDNSNGGSGFLDGLFSSSDNSESNYYSSSDEEPDFLARLIREFIGGSSTTDSYYDSSDSNYYYEDTSNGYDLGNGFSYDLNELFTKTDNKLNQLFN

SEQ ID NO: 66 - protein, 322 aa, Methanobrevibacter ruminantium
MNILINGTGAIGIGLGASMISQGANVSFFAREETANAIRKNGIKRTGIFNHYSFGPESFKVYTDYKDIPDNEFDFVLVSSKTIANDDISRKLNEHKSILKEDAKIIIFQNGFANDEPYLRFFPKEQVYCARVITGFKRPERYISEVTVHTEPILLGSLQKDDDGEFIDSRPVSIISKMINDSGIPSETTEELDKFLWAKMLYNCSLNPLGAILNGNYGKLMENEYSVKIMNELIDEIFEVIKASGYRTNWDSPEEYREVFYSKLVPDTYNHRSSTLQDISKRQKTEIDTLNGKVIELGEKYGVDVSVNKTIYNIIKTIESEF

SEQ ID NO: 67 - protein, 162 aa, Methanobrevibacter ruminantium
MIIVTTICVILILIVLFYGLFPGLTNSNDNSDNNLIIQNQTSHFTIDIENGTYLSGEGKSKMVDSNYSTLESYENFTISGYEAYEIELDNGSWYIVSLYKVDYNTPSSDWVYNSDVDEDGNAYIFFNSKGEYYGYFINIPSSSDPSTFENLSFLTSIFHYNH

SEQ ID NO: 68 - protein, 80 aa, Methanobrevibacter ruminantium
MSDVGKTVITTIITLVTTAFGLVAGLAWNDAIQKLIDSVMGPGDALTGLFTYAVIVTILAVVVTIILARIAAKMGVELEE

SEQ ID NO: 69 - protein, 139 aa, Methanobrevibacter ruminantium
MKSDKRAKFAIFFSIAILALGLSNIAAVWTGDLISGSLPVINETDKLIALDNDNFSPASLNTVYEEKKVVEVVNDTSDANDTDSTPNNADSNTESDDTSNSNNNNNNQNSNGNGNQNTNPNNNAEPSSGGSAGQTETEE

SEQ ID NO: 70 - protein, 36 aa, Methanobrevibacter ruminantium
MINGIMDKQKVITAFGIILFLAAAFSPFVVLPILGV

SEQ ID NO: 71 - protein, 43 aa, Methanobrevibacter ruminantium
MFNKKMVLAISLLAVIFASMCIVSADDSGEGSFKELAKLVSGR

SEQ ID NO: 72 - protein, 744 aa, Methanobrevibacter ruminantium
MKTNLKKTTIILALLMAILILSIGAISANDLTSADSNVDMNNDLNTNLDSNDIIANSNSNSIDAEIDEANYSNQRADAKEKLKESNSLIENENTEGNTQIEDENSSPSNKTDTSISIETNSIERGSDLTIYLKDINGTGIANEKLSIQIINKTYTRTTDSKGSALFKINLASGKYPIAISYNGSEDYESSSDDFNISVSPMKTKINMLSNSIVNGRKLTIELLDKNNNPLKYKKISIILNKKLYNLTTGKDGKVSLNINLNPGKFPIQITFSGDANYHTVSKSSAIDVYKLKSSFTVPKTSIIKGKYLYVYLKDSEGKAIPSAKVAFKINGVSSTKTTDKNGRISQKIGLKVGNYTVQLNYNGDKSHLKKVQSFKIRSCNSKTKFTVANYTVVRGKYLSVYLKDSENANLANKKVTFTYLKKSYTKTTDSNGKASLKMTEAGTTTVNLQFKGTGPYLKSSANVKIKVLKNTTADIIAKNQTRHLNGSSTIRYYVKLTDNNGNPIENETIELKVRCNNITTGSGNKITKKTIVLSSDNIINKSEDKKLLNEMAKILRAKGYKVIVSGIGPNYHVSDVRDYSNVCVFSLVGGVDSGMFVDMSHSYYKNYLKKYKNQFVLGCVAPPVYLNLGNMTWLKRAHDDDYSPKSFKGLYYPGKYFNTVTKLDYVYGDGAEELVNNFLNYAKKGKSIDLGQSVPKTTTTYKLTTDKNGNAYVDLQVGTYTISSSILGNNYKVDTQTSKVNVIK

SEQ ID NO: 73 - protein, 244 aa, Methanobrevibacter ruminantium
MSIVSANDLNSIDDSIEADNLNSIEIEDIQVDSVESDDLEKSNIDEKVLSDGESDGDSGNETETLSSGDENNESDVSSNPNEGVATNLELDNDADKENVKIGELVTWTLEAKNYGPYDAENTQVYDELPEGLEYVSHTVTKGEFNPETGIWKIGDLKVGEKEYLKIVTKAVTTGEKVNKANLTSDTDIIDPDECYEEEEIDVEDDDDNHFEKVIHSKQLPRVGNPIFLLILSLLTVLGLNTRKK

SEQ ID NO: 74 - protein, 251 aa, Methanobrevibacter ruminantium
MNSKGKYLVLFLILILSFSIISASFAYTGTGFSHDIPFSKYSSQSNSDILNKYNNTDCHSEIKGICTYVADGDTIDVEGVGRVRFVGVNTPERGVTAYICSKRFVQKFCLNKEVSLDVDDSKRNDRYGRTLAVVIVDGKNLNEMLLKEGLAEIMYIPPSEFYPYDWSSDSTTSSSYTSGSSSSNSGGSYSSSSFTSGSTVSAPYVGSANSHKFHYSTCKWGKKISDKNRVTFNSRSDAISQGYAPCKACQP

SEQ ID NO: 75 - protein, 613 aa, Methanobrevibacter ruminantium
MKKNLSLKNILILSLIFLFVLSIGSSFATEDLNTTGDNNLIDDNAMADTLSDEKEISYQKPLMSDENSNSNNGSDEEKVISSNNSKSESFLIIRPNESSITVLGGNFQDLQDAIDYASDNYTIYLICNMLGEGKPIIVNKSVVIEGNGHTLDANYSSRIFCILSDNVVLKNLELIHGYQRAYDSYKLRPYDSKNFDNAPALTQEFFDYSVPPLNSTDDIEYGWGPAIKWLGNNGTLIDSAILNNKIDYANDIGEGKAVSWLGTGGRIINTFMVSNEYHHFFVPWGIVGYQQKSEGKVLDTSPHGVYYGNIEGNVYFLDVALNVLPNLDVKNVTSYYGEGKKISFNLNHGNASFVNESLELSILSKKYNYTFNVFSDENGNFEFNLPKNLSVGSYNLIVGFNDGKNNISSNTTVKINKATVSVSAPDFKAQYYSGAKYTLKLINAKTKKPISGMKVNLNVYNGEKVKTYTVKTNNKGIATFDKFTLPSVIYDAGKHKVTISVDKSYDLSKKEFTVQISKAKTDIKLSKTSFKYKKSDNLKISIKNQIKKTAISGLKLKVKVYTGKKYKTYTLKTDKNGMVKINTKILSKGSHKIQITSEDKRYLVSKTTSIKVA

SEQ ID NO: 76 - protein, 985 aa, Methanobrevibacter ruminantium
MKRNIYFIILLVTLFLISMSVVSAANDADVSYIDDEIVSDEYLELSDSEMGISDIDYDDIESDMLENEIKENGLSDNNDVLKSNLPENEFKESNYNEYYEDIMNSNSQKYGEFINFLINNKSFEFRENSLSEDGYFLYATKNYTLRLWDGVNYTILKDDYYFASTAEKSGYFVNESFYDDIIYYHEYNYYLDEEFLGWLMWNANYKKVFVSGSIEDKVDISSVVNPEKGGSPKSGNLPSSYDLRDYGFVTPVKDQGNTANCWAFATMAALESHLLKTENTSYTLSPQWDFSENNLKNVMSSLGRNGTDKLVNSGGNMLMSLAYLIRWSGPINESDDPYNSNYTNISEDVYPLKHVQGVKFIPNRQNYLDNDYIKESVLENGAVYISMYWDSFFEKNDAYYFYNGSGYNFNSNYMHAVTIVGWDDNYPKNNFLIQSEGMGNGAFIIKNSWGTNAGNNGYYYVSYYDQMLGFDNTYAGFAFTNVENVTNYDYNYNYNPLGFTNVFPVNSTSAKFANQWAALKSGTLKSFGLYVVSPSICTANLIVNGISIGNTTSYLSSAGFHTILFNQAAYVNVGQTFRVEITLQHIGSSHTYIPLEERIENYSNVVSGYNQSFLWLRKNGVDQWVDLKTEVDNANICLHVYTECIEGLLETHVRSNNLVTYFNTSSLNATLVDGSGNPIANKLIYFKLLNVTYNRTTDSNGKVSLPIHLNPGSYKFLISFLGDSIYHKSNRLVNVKVNKMHTNINQNVSTVHQGEYLGLILKDSNGKALSGQKVAFCLLSVTYNRTTDSAGKAKLLIRLNPRKYTFTLKFFGTAGYYACNKTFNLTVLSAKSGQSYEMGIDDYDGKNIDENIIINNETFESSDVVNNDIMYMYNDTQYYNIINEDKGYYNNHSNDINFELLDNDQNYIYSDLNLLELLNNDQNDICFDLNLLEYIDFDKTDYYNDNLYNLEHYYMKDSLTENEDLYICENKLNIHDLNQIKIGGI

SEQ ID NO: 77 - protein, 71 aa, Methanobrevibacter ruminantium
MKKMEMASYIILIASVLAILYALIFNPADWIVYAIAIVCIPFLVLSFGLLTMSKPIKEEEEERREEPFTGY

SEQ ID NO: 78 - protein, 199 aa, Methanobrevibacter ruminantium
MPKIAKLWNKLADPKNIPRLFAVILGLLLIAGFLIPMGLNTDQIYTRPAPQSQMDAGLPLAPYDRGGEVLESPGITEAQYPENAENLGWINSYMTPIAEMLKGISPYFGTSICSSPGGLIDEILYYTRGFDTILESSILMMAFIIASWLAINFTMDRTKDERDIAEDVKRAIASSDRLANEVEESNRKAREKQAKKEFR

SEQ ID NO: 79 - protein, 86 aa, Methanobrevibacter ruminantium
MFNLAIWVYLGLALAIFGSLATVWGPGVKDPVIRTINTEVASVGVSLILLCYNSTLALLTLIATTIIVTLILFRAISRLEEIGADV

SEQ ID NO: 80 - protein, 480 aa, Methanobrevibacter ruminantium
MFAIVSLSAVSASDDFSSSLADDSDSDILAIDDIAQKDSSHKLMDEEDISVEFEIDDGDDDTSYDSYYDDSPGDDWSNYEDYDPELISEDAILTKIEVLNVPSHYGDDNISFRLIDLNTGLPIPDVNLGLQDSYDYDVYSFFTDEDGVVVYPIPVKVGDFSIVIGFYEDMMVVNELDDMVCNFTKLNVSIPTVPASIKITKTGTYYNDTVLKVSLVSSVKEVLSNQKINLTFSNGKKATVKTNSKGIANYALKFAPGNYSVTAALVSDGIVEANKSSLKNIKIIKAPGTLSPTALSTTYASGKYFQIKLTNSKTKKAIGGVKLNLKVYTGKKYKTVTVTTGSNGIAKFSASTLSVGTHKVIVTVKDTKYVSASSKTSSIKISKASRAISAPKVTAKYKSSSTFKVTVKNKASKKILSGVQVSLKVYTGKKFKTYNVKTNSKGVASFNTKSLTKANHKVIVNIKASANYNAASATSYINIK

SEQ ID NO: 81 - protein, 500 aa, Methanobrevibacter ruminantium
MEENPIDFKDNSINSKALKDSDYEHASDELSQDLYNRIINAKENEIILIEPGTYKIHKVHLTKNITLQGTGDPREVIIDGEQLGSVFFINDINVTAQFYNLTIINGLSDNFGGGICIETGNTYVDNCIFINNTALNITNGGAISNYGNETNRSYLFINNSLFIGNHADHDGGAVTTCYAISDIYNSVFINNSAVRDGGAIRVSVYGYGNVQDCIFIGNHADEWAGAYYSWAGNSSIDRCIFLNNTAGTNGGAVMVSGSLNLTNSLIVNNTGGETGGSFYIQQPMFDAKTVINVNNNIITNNSSPLGKEIFVKWNATQLLFPNFNNNDWGDEDPTGPDVVDPNNVSDRIIPERTKRITVLYDKLNWGLLDRYTDVLDDYYGKSSSSDSKANSDTKTNSSGLKFDTENKTNDDSKEEQGSILNNSNGFALLNHNNSSSSNSTAGGGLEKKDNSTFVSPKDYQKMVELFEDNPSASKSTDIRYFAVLAFILLVFLVGLARKRK

SEQ ID NO: 82 - protein, 481 aa, Methanobrevibacter ruminantium
MKRRYKVLFLLAILTIISINAISASEIGLDDNNAIDENDGFKIKQDIMSEKIISDNEDADSNNANDVNTDSSDEVNEDNVIEQNTDTDTVDEDEEDPIIPVDTRLFNPDSVIKGNDLNIVLKDIDNNPLANQTIKFNINDKQYQRTTDKTGTAKLKINLSPKTHTFFIEYDGCDEYYPTNLVFDLKVIKPVQTKLSVKSTIVYKNNKLMVYLKTSDNKALANQKIKIGLPKKTYTRTTDKNGLASLNINLNPKTYSINLSYDGKGKYLPTSKKIKIHVFENELLGSTYYGKVELLKGIGNSSSKVKIAYVVGLHVLEHQIHDEVYNIMKQKTSMHYSYNVYKITLTKKSGNYNTDRMRGQILAKNYIVPHVNKQKYNLVVDVHSTTGVYYKKSYFIHVPQNRHKPSLNLANKAIKIINTLDKQSKIVYWSPDSQTSPPYLTLPIMKAGTPTFVFETLTSEPVSRSKYRANILINAVDKLFG

SEQ ID NO: 83 - protein, 408 aa, Methanobrevibacter ruminantium
MLFSVIATVSATCNVIVITDPSGEDPNGAAAGSMSFANNMFQSSFIMSKDDGYAMLSGGEGNGTERNYAIIAALAAMQHGATPASAAALASGFKGIRLVIGGPSMGAAIGGDYNAYLVVVDDAGTIKVTHHTGGVVQLPQGSKGAIIHLRNSAGNPMYGTAERVRRETAVNIGKMIRDGYPATYIVGKAMKEVAEDSGEKYGGGAVNLVSSISTGDMFVPDQVNTTGYPMDENYSKSCEKCGWATGFPDAERYNVCPYCGSELTVNSATDVLIDSITVSKDSVSVSVYGSDRLGLSDITREVVKASVKKYGYNASTIAGSLNKGINNGLIVGVDYVEPSDLNVKPDVRAVGVYYNPLPNGRSSPAWNLPINSMVLTILGTIQTAIGFVLIMLVIFRTRLLKSFKDRVS

SEQ ID NO: 84 - protein, 165 aa, Methanobrevibacter ruminantium
MFIKIRRDTLIILLLAFILILCGRLIIYVAYASSAQVEEGVPIAGIIVKGNDIVPIDNIRYNVENSGLREGSYIDGDILKTSIRELPVTEAEANAEKFVKRSTIPGTTIAPIAGADVNVNKQTGIVTVTVIEDFSTINITGNSTTSTDFTENEPSKSVYNYSLAG

SEQ ID NO: 85 - protein, 281 aa, Methanobrevibacter ruminantium
MKAVIPAAGLGTRFLPATKAQPKEMLPVYDKPTIQYVIEESVNSGVDDILIVTGKGKRSIEDHFDRSFELEHHLKTKGKEDFLKEIEYISDLADIHFIRQKKQKGLGDAIYCAKKHVGNDPFVVMLGDTITKDTVPCTKQLIDIYEKYEKSVIALEEVPDEKVERYGIIGGEEIEDSIYKIDKLVEKPPLRVAPSNLAIMGRYVLTPDIFDCIENVEPGYGGEIQLTDALSKLDEIYGQVFKGESYDIGNRIDWLKTSLRFALEDDSARDDILEFIKEEII

SEQ ID NO: 86 - protein, 924 aa, Methanobrevibacter ruminantium
MNCSVYEDYSENIITADLNSNSNELNSDFAYGDSDSEEILDEPSQKLKTGSDNSDFKDIQNLIDNAKENDVIELSGTYTGDSLIVVNKSLTLKSSSSATLDGEFLNELMAINAPNVILDNINFINANYTGLSVNNNYVTIQNCNFDGCINGELGCALIIHGNNVNVLNSNFTNNVANKSSCHHTDGAAIYLIGNDCQIDNCSFINNWGYNFETSSSGGAIWIKGNNIVINNSYFFNNSATAEVGWTFHGEEITYLADGYGGAAFLVGKNVKIINSLFDSSLSHAQGGALYYKSAYDCSIINSTFLNSFSVGEGGVIYLGQNIDGLMIDSCNFINNTADGLDGVLVKYTDLGSVLYASKFAENVVITNSSLLNNKGTSAVYFLGNNLNISNSIIENNNLSTAVIYMNGSMNDNFWSKNFDSADEFKNDCFIIRDNESQVPDTWFNLVCDGLDSLKAKGVYDYNMSFVLKDASLDNHASKISLTNNLPNYHINLKNSAKNKINPNELVIVDNQADFTYDYIESAKDSIDVYDDYNNLILSKKVLSGITYINDSGNDTKDLQDAIDSASSGSLISLSNKTYVLDTILINKDIHISGEENTTVMLSNSSDYIFKISNCSAANYSDYGIAISNINFILDNGDIVALAEAVNGSGSLSIDVASIKITDNSFTSREGVVRESITILELDSQRAVLAPTRNISISNNSLEIGMNPFDFNVKSVINGSDVRVDVGGNLASKKASQIICKDMVTKAIASNVDSRSGEYFNVSLKDSQGKPLQNKFVQIGFNGAVYNRTTNESGELRLQINLAYKGVYTFAISYLGDDECNGSFEVAKITVNPQSPILMANNAKYKVSSTKTLSASFKSMKGSPISGKTIKFTVDGKTYSGKTNSNGIASVKVSLNKKGTYKFTAKFAGDNTFAAVTKSAKVVIS

SEQ ID NO: 87 - protein, 369 aa, Methanobrevibacter ruminantium
MIKTDVLVIGAGPAGSSAARFAAKGGVDVILMDKKSEIGAPKRCAEGVSKKTFDKLDLEMDPHWVTQEIAGVRLVAPDGTDVWLDEDVIDLPEAGYILERKVFDKHMAMEAGREGAQIKIKTQAKGLKREEDGSFTVTCESMGETFDINAKIIIGADGPESHVARWAGLKAYTKPKHMEAGVQFEMCNAKMEKSNVLEFYFGSVAPGGYFWLFPKGDDIVNAGLAIIPDMAGDKSAYEYLVDAVNNCYATKDAQPVELNVGGDPVGGLVKEMYGDNIMLCGDAASQVNPLTGGGITNGMMGGRFAGEVAAEAIKAGDCSKDFLKKYEDLVKEEMGHEMQKYTKVCDYLWTLDDDDLNSIAHAFQDMEFT

SEQ ID NO: 88 - protein, 482 aa, Methanobrevibacter ruminantium
MSSNSLSSNELNSNQLNSNQLNSNSISNSNSNSNQKANSKDSRLILLNDKNLKVNGTEEKYFIKLVDGNGNPIPYVDLIFNIDSSIEFVGGTVRTDENGIAYIFMDFSYPGPYTVYASFEGDGNHNPSSTLSSTVSVYKDTEISSLQSYGYLGENFSFKITSCGEPVSNQKVLISIDNKNYTATTDSEGIAKVKLPNQQKTYSISCNFSNRVYYYGSSLSKNIPVYKRAFTQPNCYALLRKSTFTVTLKGADGKILSNRTLRFIVDGKEYNKTTNSKGAASINIDLERGEYRINYYFNTDGVYGPVSNYTDLNVVDPSGQYKRLLNVKSSASAKIYLTGGGYATVTSLIKSTAKSITKKYKTNFEKAVAIYNYVRDNLDYQYYYNTRKGATKTLKTKSGNCCDHANLVVALCRASGIPARYSNSKYCVFGSGLRSGHVWAQIYVGGTWYSADATSSRNTLGHIENWDTKTNKKDYNFRNLPF

SEQ ID NO: 89 - protein, 1003 aa, Methanobrevibacter ruminantium
MGFVLISSVSAIDIDEASSSSDLSDSSISNDYLVANSGDDSVASSSASSSIAADDSDLSNNASSSNVNFENEVLSTNNNEDTESEIVKDSKNQLSSSSLQASTKTKTTLKGSGSSVYRGNPYYVTLTDSNGKVLASQKVTFNILGKNYTRTTDSKGVASININLAKGKYNIACLYAGTENYASSKLSVALTVNLMSTKINTGGSTVKKGNAYSVTLTDGNGKALSSQKVTLNILGKNYTRTTDSKGVASIAINLAAGKKFTLTASYAGSANYLSSKVSATVTVQKGDTSIKPSGTSIVKGNSYSFTLVDGSGKGLANQKVAIKISGKSYSRTTNSNGVASIAINLAAGKKYSIVCSYAGSSNYKASSSTVSLSVTNPSTNSKTFSIAKIEAAATNLKAYVNKNKAVPTTVSVGGTNLKISEFSYLMSKAIVNLNSNNTNAITLPSGIYNGASASNSLNATVYKAQYVDLSKRVYNYIDKNKVPAAYGTVYNANGASLGNAGFNLYTFAFAKILDFHKTNKYLPNYCSFDSSVFKASNGSSSSNSSSSTNSSSSTNSSSGSSNSSGSGSSTPAVTVKATSLKAASTSVIRGDDYSVTLTDSSGNALANQKITFALSSSSYTRTTNSKGVASLTLNLAGGKYSITTSYAGTSAYKASKLTNTVTISNSSSRFFLNDIETAAENVKTYVTKNKALPNTVTVAGTQLTLSQFSYVMAKAIHNINASNSNYISLKSVASSNSTGDYLDTTVYRAQYMNLTNRVISFVESDKITPTFATVYNSNGKSVGKAEFKLYTFAFAKILAFYKTNNYLPTYCTFQSSAIGVVPDVATNVTINSKINANMNQFKVGLNEKNTVSNLSAYLVGTGQSTITTNIKNVAAQLTKGLNSTATKALAIYNFVRDDISYSYYSDSRKGADGTLSSGSGNCVDQASLVVALCRAAGIPARYSHAQGCTFSSGLVTGHVWAQILVDGVWYSADATSVRNSLGNIVNWNTNSYHSMKQYAAVPF

SEQ ID NO: 90 - protein, 1024 aa, Methanobrevibacter ruminantium
MEDNLLKNRKLILISIFLVSLLAISAVSANEDVDNGLIDSDDSILQSAEVSDSAIGSDSILQSAEVSDSTIESDSIELEDKGNVLKSSDNASFELDDKNNIGSADSELEDDYLEPKEKNVLSMDENAWFYNYIVWYDGDDGDWVSLDFVDDLKNPENITIRLNSYDTPFDGVDLAVINDYDYSITKLTTDDNGTVVYNVPYEVDELSVFVGFWYDGDFVATYGNWESYTICAVNWGTWYRDPSKRTYDFYVSVSDMDTYESPIGAQVVFTSDSNQYVGTIDENERAIIPKVSYGTYDVKVIYDGYCILNLSDSSAIEFYDDHHTDPDSLGDERIDYMYVDSSGVVYLDLCYDGSLKVPDNSTYEPYGDDNPSGGGSGNQSGGTVANGTFTSLQSLFNRAAANSTISLTRDYVYDDGFDIKGIVINKDLTINGNAHTLDALGKSRIFYVNNSTVKFNNILFANGNATLGGAIYNGSAVNCLFINNTAQDGGAIYYGSALVCDFINNSASRNGGAIYSGGAVNCSFINNSANLGGAAIYDSLFAVNSTFVGNTLASSNPTGGSATTDVSVVSFNPITTYIPSPPSMTGSIGWGGAVLDFTRPVIYTDYNETFYLLTNFTLQQDGFNNYGNVQLTGRDLVFKSLYPYSGNYSMALIISGQIFTPTYVLGENDTYEAHFKLNGLSLGLHMVYAYVDFGYPEYYSYRIGGGYMDRVAYDRTAEIIFPILINKTVEISSSNLNKYYGGTGKYTVTLTDGGNPIANANLNVSLAGKTYPLKTNANGQASMDINLTPGTYEAVCTYDGVSQRSNIIVRSTINLQNLTGIYQNAKVNATFLNAAGSPLANTKVSFRVGSKTYSATTNANGLATANVDLAAGTYDVIAINPVNNEQKTSKLTISKAKSSISLSSTSNNDKVTLTASLSPSTASGNVTFNLNNKNYTAKISSGKASQTITGLNEGNYTANAYYSGDSNLNSSSASTKVVVKIVIPTKIIYKNMTTGPVAKSDGRIGNYFCVKLVDGSNNALTGLP

SEQ ID NO: 91 - protein, 145 aa, Methanobrevibacter ruminantium
MNRNKIIVLLVLLIAVVGFTMGPACAASTTIKVGNYKDVGKGDRISTFNVPKDAQYLKGVYAVIFYHGKNGDDFRPHTYVLSKIKVYYKNKKGKIVTRSSTAKNLSGLSILSTKQVSGYTPYKMDVSYRKMTNAEKKKICGSLVY

SEQ ID NO: 92 - protein, 285 aa, Methanobrevibacter ruminantium
MKKSVFKILIALALILLAVSIVSSNDLSDSNVSSDLTVDSDSISSDDTGSSDTSSDDSNQDDVSQDKTNDKKLSDSQSDSSKDTQDTDDNNTDNGSDKCNLIITKKGNEKVKVGDTVEWTIEVKNSLNTAENISVDEFLPQNFEFKSAKASKGNYAVEIANWDIGNLKENESATLVIKAQALKAGNFTNVANLTTDSDNINGKVLSAKADVEVLSENKKNETPVGPKKNKDNNSTVKKIHKLIKNQTNNTNMTPIDFKKSGNSLFAVIIAALAVLGIFLGRRRIN

SEQ ID NO: 93 - protein, 590 aa, Methanobrevibacter ruminantium
MDLSDSCCDTLISDGSDGIILGGSDDISLSDENNNLNFDLNDNPDFNLDYDSNSYPNLNLSSNSNSKSSSNTYGNDFTLSRFKSVLTSSYNLNGGSFEDIQSAINHAADGDDIILNGTFTTTGSVIVINKTLTIIGSPNAVLDAKNISKIFLVEADGVNLKNLTFINGKSRNESDNGPYQGTVNWQGSNGTIVNCSFINNSGDEKSYGASILWKGSYGKISDSIFKNSYSGANGGAIFALGENLTINNSEFINNHGKEGGAIYFGGSSAMWIINSIFINNSADSGGALAACAMNRQVINSKFIGNSANNGGSISWCGSNGLISNSTFINNSADQKGGSILFTGTNNLVKGSVFINSSANIGGAINSLNRLNYINDLRFENNNASLGEDCYGDLEFKRFSTSIASEDMVTSAIDANLDGRNGEYFNVSLKDEYGNPLINKDIKIGFNGRIYNRTTDSNGQASLQINLKYSMVYTFAICFLGNDDFYGSFTVSKITVKTQKPNLEVNNFKYKSSTKSKVIKATLKSSRNNPIQGKTISFTVNNKVYTAKTDSKGIASVNVSLSSKKTYAFTVKYAGDDTYSSVSKSANILVY

SEQ ID NO: 94 - protein, 169 aa, Methanobrevibacter ruminantium
MKKNIFLIAIILIAVVAVSGCINSPMDNINNNMKELNTDITEGDTDYNSAINYINNKDFISGTDNIQIAKDKFNDADEKLSNIEQYKSSLNESIYLDYLYLIKEEVSIKRQASDELYLALQYYTNNDFSSGNSYAQSANSLMNQAKVLQDERNQIVENNPDLFKKAGII

SEQ ID NO: 95 - protein, 233 aa, Methanobrevibacter ruminantium
MLIALLGLSAVAAVDADPLTDNQLNPTIFYLDFNHGALNDGFKKEFDLFEYVPTFDSVDLYNDGENVSVSFYSLNPTIDVDNLNDEIIDYTFEVMEDPKANITTLKDGIRNICSEYGADDVKINVDSVIGEDEIPVIFTTEGDSMLPTIKSGDKVLVNKSHNIHVGNLVSANSSEYGPICKRVADIDGDSVYLVSDNKKVTREYYDDYYVEYKGITTWVNIDDIDGVIIDIMN

SEQ ID NO: 96 - protein, 285 aa, Methanobrevibacter ruminantium
MSENNRTLITIGIGAFIIIAILLLIALVLPFSNLAVDNDEIAVITISDTITYGDNSTSAHTSKKEIESELNDAYSNPKIKGIVLDIDSGGGSLVASDEISDLIKKSPKPIVSYIGDKGFDEAYQIASATDYIFASSSSSLGGIGLSYINTDRYSDEKVTGVFNEKYLKNNKTKSNSKVKSANDLANAQKMVDQDYTLFIKKIAENRNLTADYVAELAHGKKYNGNEAKKLGLIDEIGSKSQSIEKAAKLSNATNYTVITYPEPQKKLTEILGENDIFNLKELIKI

SEQ ID NO: 97 - protein, 229 aa, Methanobrevibacter ruminantium
MGKIFKIVTIILIVIALAILGVFIYSDGHSEKIGENNLGVVYKVTYGHSNDPNVTIGIVSGMHSREKLHQYVLPYVSKAFAFLHPDVKIVNYIVNVTKDPEDFTKGRANGESLVHDYVVKDVKKEDFDVVIIGHDHEPGYGEAYYIATPVMDNASVKLAKKVTKDIGFNHYTRNKSQPTTSTSILKVDKPIVDAGTRVFVYEIPEVDGKVNAFYKSYQLVNATYNRLKK

SEQ ID NO: 98 - protein, 539 aa, Methanobrevibacter ruminantium
MDKKTIIIAAVAILVIAGIAVFAFGGGGSSDSDPTHLTVATHSNMAEPEAGFNPLTGWGCGHMNYNPLVQSCLFKTDKNGDIVPDLATNYSISADGLKWTVKVRDDVKFSDNSTFDAKDVAFTFNTAKDTETDLDLTNLKKVTAKDDKTVVFELEEPRSTFIYDLRYVGIVPEEYDNATYGEHPIGTGPYVLDHWDKGQQAIFKANDNWYGDKPYFTQITMLFPEEATWLELAKSGQVDIAPVATSALNESVDGYNFVEKSAGRAQGISLPYLEDTGKTSPAGAKIGNNVTADKSIREALNIGVNRDKICEEVFSGHASPEYTSVDTRSFANPNAKVKDGDVAKAKQILKEGGWEDTDGDGIVEKDGVKASFDLYYPPDYLDRQSLATVFAEQAKDLGIQVNLQGADWDTIYANMYSSASVMQQTSPDPYKSIYQQYHSKEADDFYMNPNLYNNTASDMLMEQAMHSNDFKLADSLWAQSALVNGGGWGPAGDAPWVWLANYNYNYFVKEDIDMGDQPDGLGNDFLINVVDWTRTNSTA

SEQ ID NO: 99 - protein, 1024 aa, Methanobrevibacter ruminantium
MEINLDHKDHDGSLSIIGDSNGGTVFDGENLNPIIISISEDSIVTLINITFTHGKNNMGSAIRSSGNLTIDNCIFTENYATNLAALYVDKHSPLTVMNSKFLENRAKQCADIYFSQNSEIILLNNLFEGSTAEYSYAYSPSVSLQTGKSLVKGNTFKNLTGAYYKGALYIAYNNGINIANITDNTFINCNYTGTDGAILFFQNAYLKNNKFIDCHSSTAFLYSNTEFNAYLSFEDAEIDGTTFFLKANVTDDMGNKVKNAKVIFYLNGENVGSASSDNNGVAMISIKKLLENGEYVISGTQSYSEINPFGVNVKNATARVNYDHSSLEVWVSTDGDDGSGNGSEDNPFKTLRKALDYGTASAVNLTVHVKNGIYNGDDNRDLSYSTLGKITIVGESYSNVVIDGENITKSIFAFSSTLDVTLINLTLINCPSTLINAYTLSMMDNIVINSGTIRAQTGNNGVTIDNLRVINGTDQAITGYNLRLTNSRFENCDGLTHTGLIWLSTNNNKVTYLENNTFFNNTIAGSAGGGAAYYIQSDLISINNTFDSNWITESRGENVAYAGGRHIISINDKFINNEVPKYVAQYRSIGNEECEIIVENITFINNKASGNGAGLATTGAIVKGGKFINNSASGNGGAIYLLNHDNTSSYCQMSLEDVIFENNSATCGKDIFIEGSSGNNIFTYLNNLTIVANDLNVTSLSDNLTVSVFHPSGAIIGGGEISFYLDGEYIGKSTLVNQNASLEYVGFKNNTIYEFTSIYEYASLNDTYIDGIVSTKIPYALENIELYVSDGSGDDENGNGSISNPFKSISKALSEGYQKSTNITVHILEGTYTGSLNSNLRIPTTVNILLIGEGAAKTIISDSSSDYFITALKGKCELRISQMTLNRAARDTQSAIYIEEESNVAIDNVTFIGGQGNYGGAINTAGNLSIRNSYFHDNGYADRTLRANAYYGGAICNDGTLIIDNTIFESDHAGRLSEIANQGTLYMNNSKVIDSINAYSINMDLVAIGAYGGQKGEITIENSQ

SEQ ID NO: 100 - protein, 274 aa, Methanobrevibacter ruminantium
MKKKIAIILGIALLAFLVIGASSAGFLDFLGGDGTATNDDNTFIVGFDAEFPPYGYKDDNGEYVGFDLDLAQEVCDRNNWTLVKQPIDWDAKDSELDSGSIDCIWNGFTINGREDDYTWSEPYIDNKQVVVVKTDSGINSLADLDGKIVETQKDSSALAALEGDNKTLADTFKDLTQVADYNTAFMDLETGACDAVAIDIGVAQYQISQKGSDQYKMLDEEISSEQYGIGFKKGNDQLKDQVQKTLDEMFEDGTVEKLAQKYDTYGVPGALIQK

SEQ ID NO: 101 - protein, 114 aa, Methanobrevibacter ruminantium
MNFNKKILLIIALVFIASVGIVAAEDATVDPYTFTIPDDYTIATSDDTTCAMQKDATHAISFATGVSDDIEAAKQNFISQGKTLLKEESMNYNDMDITLQAFSADVDGTTIICL

SEQ ID NO: 102 - protein, 273 aa, Methanobrevibacter ruminantium
MKRSIIFLTIILSLFLVIGYASAGLFDFSSDDAGSGENTDDVFVVGFNSQFPPFGYKENGEYTGFDIELAKEVARRNNWTFKPVPIIDWNTKRFELDSNEVDCIWSEFTIDGREDDYTWSQPYFNNTKLVIVRGDSDINDLDDLKGKTLEVQQGSSILNTIEKNETLKRKFAKIEQVDGYDTAFMDLESGVCDVIIIDSGLGRYLVSEKHNDTKILNQTISNEKYGVAFEKGNTELRDKVQKTLDEMYADGTVEKIAQKYSKYGIPDGVIYPE

SEQ ID NO: 103 - protein, 379 aa, Methanobrevibacter ruminantium
MGITFTAIITGALGGTTFSEPLGNYLSQFIPYSYQISFIIVILLTSYFTILVGEIVPKRMALNDPEGYALSTAKFMQISSIICKPIVKLLDSSTNLALRIVGPSPKEDVVTEEEVKLLIEEGIEDGTIAEEEEDIIKRVFRLDDQKVDMIMTPRNEIIWLDLEDEIEINKAKIIASKRSIFPVADAELDDFIGVVQAKDLLSKIFEGEDVDIRANVKSPLVVPENMLSMDLLKEFKENREYVHMVLVVDEFGSVVGLITLNDLLEGIVGDIPGIDEEDDPKAVERKDHTWLIDGRFSIEDFKDLFEIEKEMPNEVEDGYTTIAGFILSHAGKIPETGEIFHEDKFTFEIVDMDGNHIDKILVTINEEDSDKLDLESKED

SEQ ID NO: 104 - protein, 167 aa, Methanobrevibacter ruminantium
MDSKKLILVTALAFLAIVSIASVSAWDLFGTADETSSTAKTTIAGHDFNIPDGYQKNESYVLDNETTNSNGAIFYSTAESYYKGADDIIYIQVADYSYPGYEANLTTAQLLKSGLGDKETINGHEGLIAENEFDGLKVHAFFYAEDGDCITVITSDDNLFEQIIPEA

SEQ ID NO: 105 - protein, 451 aa, Methanobrevibacter ruminantium
MNVNKKIFLLVIFIISISIAGVYCADIHQDSDLTAILSNETDSGLTAIMSNETDSFGCCSIVLQLDGNESIMCYRRDSNYTADVFIEKVNWHGKPAIKQYKTDNKYFNHVIITNDGWIIGLGGIDDGIDSEICENITAKMITKDYSISEDYLTQIQEIKKKYGRGHVVIKAPNGNYGFATPTKLKTGTLNVGEYISIPNNYELSRRGYVSLDEPDKIEAMINLSRTDLYGDDRREIITYDVHLNGNNNTTDIYISNEDGSLIGKDYTGCVDNVIFNNVTIEGKDIPIAPNYKSLGSMSFEVDKVNLSLTDLAFIVVGVVLVIALLFVLLLRLIRFIKTRRSRRSAPRRTRRETPRSSRGSAPSRTRRESPSRTRRETPRPNLRNARRRDTEEDRRRNDLRRNVLQNIVEDKRRSEPRRNVRRNTRNNRGRRRGQNRGRQQTKRPPTLYRKE

SEQ ID NO: 106 - protein, 150 aa, Methanobrevibacter ruminantium
MILALFCFIVIGSASAADFKINDGFNSSLSDYSFYNEDQNMYINIWDYDDEILSEAYLENSSSYRIVSGENNTYNFVFDSYNDMDHVISYITKGYVALDCGVLEIAEVDGKKQIILVSKEGTNVDSLKTCYDELMKFNQNNNIEPIADAI

SEQ ID NO: 107 - protein, 637 aa, Methanobrevibacter ruminantium
MISLLLISILAISAASAADDMVDADIDLASSEISEVSVDDVQATDKNVLSDADEVSVVTQNTPYNENATIDISVNGTLADDSTIKLFIDGEDKGDLNLSAEGKASYVIPASTLDVGKYFIEAVVHNGTSSFGGRSTLNITKVTPIVSVSDVTVKSGDYITIPFNVTDDKGKAIPGDVIVTIVWENDVISKHIKLNDNSSAGFNIADIIGIFGGNSTGNGTGTGIGDLFNRNGTNGTGNGTGIGDLFNRNGTNGTGNGTGIGDLFNRNGTNGTGNGTGIPGIGGNSTGNGTGNGTGDFDIASILAMLMGGGNNTGAKFAYVFEKGVYNVSVEYLSNRNYNGAINDTAKLTITPLEDVLINATIETAKNMSDNTTVSILLTDGYEKPIAGGEINVFLNGEDKGKVTANEEGKASIAFSNLLKGDYELLLNYKETNKTFDFFVNVERMGTVIEYEDMNTTSVNEKVDGRIGEYFQVTLKDNEGKALANRFVQIGFNGKIYNRTTDDKGQTKLQINLFYTGDYTFAVCYLGDDAYNASFIVAKIKVSKQTPKITTKDATYKADAKTKNIKVTLKSAKDNAIKDKKISVTVNGKTYTAKTDEKGVATVNVSLSKKGTYSFTAKYAGDSGYAQVSTKGILTLK

SEQ ID NO: 108 - protein, 127 aa, Methanobrevibacter ruminantium
MEEKIALAACSGMSPNGLVARVAVHDLAIDDHEILSICMGSTSANVEGFTRVLDKYPILAINGCEGNCVGKILKEKGVDIVGELNVGDILAETEYKANDAARLDDEGEICVKIVKDIIEDKINELSE

SEQ ID NO: 109 - protein, 278 aa, Methanobrevibacter ruminantium
MLKTKLCGISLKNPLMLAAGVLGSHASSLNWILNSGAGAVVSKSFSKEPNEGYKNPTTVAVEGGIINAIGLSSPGVDAFIEELESVNRIKGRSIASIYGATPDEFSYVAGKIESLVDMIEMNISCPHAMEGYGASIGQNPDLTREFVSAVKDTVSVPVLAKLTPNVTNISEIAIAAEEGGADGLTLINSLGPGMKIDIITGNPILANKFGGMSGPAIKPIAVRCVYDAYEATDIPIVGVGGIRNYTDVVEFLYAGASAVQIGTSIMYEGPEIFGRIRK

SEQ ID NO: 110 - protein, 406 aa, Methanobrevibacter ruminantium
MEIVLCVTGSVAAVETVKLAREFKRQGHSVKAFMTQEATKIIHPNALEFATGQEVVLELTGKIEHVKYSQADLILVAPATANTISKFAYRISDNPVNTLLITAYGHDTPIVFVPSMHDSMYDAVSENVAKLKEEGIVFLNPRLDEGKAKFPAIGDIVLESIRTVNLDRVKKNLTDDSLDESEIEDLNMEMLSKIAGLNVLISLGGTFEEIDPIRGISNRSSGKMGLELAKEAYRLGANLKILAAHHEVEIPKVFDVIDAKSSSVMSEKTIELVPDFDVFIATAAVSDFAPIVKEDYKISSSLNLSLEFEPVAKIIHQIKKINPDIFLVGFKAEYNIPEERMIQCAKTQMQDAGTDLVVANDVYKKGCEFGSDSNEVILVSDEIKKVGLNSKSEIAKSIFKEIANKI

SEQ ID NO: 111 - protein, 1024 aa, Methanobrevibacter ruminantium
MLSMASVCASDVNDTYINQNDLKIDNQDNCINYEKVVYTEENLENNLISTEDSLEDSNSIEPSDSFKQKNSLNEGNSDERLNPEIDVALNSIHVNETAEVNVTVRNASGYVLVSVDDQSFNKDLTDYQARFNITGLGFGNHNIAVYYGGDDNYLPGFKLETISVEKYQTQISEIEIGEVYYGEDAIIEVSVPNGVEGDITIKINDTLQTVITEAIHDGMALFSVSGLAVGSYSLDATYNGNDYYENDTASAEFEVKKADPNLSVVSFECTVYDNATILASINEEIHDEFVNITVGDEKYEDCPIEDYGMIAFTGGVLSNFSSYRILIEYGGNENFESAMIEAFVTPKKITTYGLDIIAQNISINDDEIISVVVPDHVDDVVVWVDGQSYRNCSFENNVAVFNVTGLGEGVYTVTATVNDTEFDHKNFTSIFTVSKVLPSIGISINETEIYVGDNVKIIVSLPIDVSENVSIVFDDRELSQKPVDGNATFYIDCLSYGNKSVPAIYYGDEKYRTAVESINFTVNKVPSFLNVAVENISISDNEVINFSLANDASGNITVIVNDETYIVAVSGGKGTLTVPKLNQGVYSVNASYNGDGKYLPSLNNSESFKVLVNSGQMEIIDERNNTVSVYLWDGATGNLSVKIDGKVYNATVVDGFAQVVISNASYGAHHAYVLYEDNESDLKLESVVDVFVPKYLSPIGINSSILKVGDIGYINVTVPMGASGNISLEIDGKSYLIAIDNGIAEFEVENLTAGDKTIFVKYSGDKVYSQNSTSESLTVFKQESSTHCSIEDISVGDVAQIKITGPSDVLGTVIVIINGSEYTASISNGEGILNVYNLQNGDYDIELSYLENSKYLSSEYRDNLSVSKIQTAISSSNIVCQYNYEGYLNVSLKDIKGNPISCAELSIDLDGVKNLVSDVNGQVKIPTKDLDANDYSVLISFAGDEKYLPSNATVNVTVNKDIPQIIASNLIADYKSDDYLIIGLEDSQSNPLAGFDLSIALNGIDGDYDVYSTDSNGIVKVPIK

SEQ ID NO: 112 - protein, 120 aa, Methanobrevibacter ruminantium
MVVATIIFASSLFDALYGFKNLIQPGISLVYTAIGTQLAPNMVTLVVFDWRGFDTLGESLILVTAVLVVLLIFGKGKILDKNVNADNGTADSNLTHEADLEIGDSDLELDGADLNEGDDE

SEQ ID NO: 113 - protein, 159 aa, Methanobrevibacter ruminantium
MILAILLAVGMTLTAVSAEDSWSFNFSSEENSDGGSINFENGKLTIQGIEFTIPDGYEMDESSKKVAEDAEDFDAKYSACKFTKGDDEIVVNVFFTDGDFENLSANNADQVEKTLNDIKGLYEENKYGDNTPTFTYIEDGKVVKINAPNDEIIESVMGK

SEQ ID NO: 114 - protein, 1024 aa, Methanobrevibacter ruminantium
MNKRIFLYIALIFIISLLSFSAVSANEDISSDNLILDENVYDEKIILDDVQDKNIISDNDYDDVIPVENANDNAILAGNDEELILDENNSEISEDNKNDKTKLSDPNTYSFTRLNQAINSGASVINLTDNYQYTEGDESFIHGIMISRSITINGNGMTISGSGVARIFEVFTSNVIINNITFRDAYAEGDSNRQNYGGAIFMYGSDSIVQHCKFINNNANNAGGGAIVLVGSNSRVEYSDFTGNNGQNGGAVYLYGNNTKAIYCNFTSNNASEKGGAVYTYGSDITVEFCNFTNNSAYLEGGAIDWEGERGTVKHSSFANNTANNNGGAISWYTANGTVEHSNFINNRMATFGGAIWWYGEKGTVKHSNFTNNSGRNGGAIQWSKNDGTVENSNFTNNTAILAGAVRWVADNGTIKYSRFINNHGYSAGAIDYHLTYANISGCLFINNTSDYRANVYEDLFESKSYSNFNNNILLNNGGNEINFNTSEGFNADYNWFGDNSLNYLDKPNIYSNTWLFLQPIVNHDSVFLGESCEITFRLYSYDGTEVHEYDNALVYPIKLTLNSNYGNVNDTVGLEEKAIFTPQTLGYTSVDVYAEGSYIGSVPINVYVPSFSDLNRTINGNEDSIITLNKHYIFDPETDAAFINGVIINRTVTINGNGFTINGSNNARIFQVTASNVAINNVTFANGYANGSTDEDKDGGAIHWSGANGNIENSTFYNNHATGAGGAIIWQAQYGNVSTCLFINNTADDGANVYHNNYPSDSHSNFNNNIMLYNGNNEVHFTVYNGSNADYNWFGHNSSNYNDATTGIIGDIWLFLNATANPDTILISNSSEISYKLYAYNGREIQEYDNHLLYPITLTLSSTNGIVNDNVALEEKVIFTPQNLGTATVTAKAAGTDIQTISIKVFEASFSDLNRTINGNEGFEIILDKNYAYIPEIDAAFINGINITHTVTINGNGNTINGLDKARIFQVTAPNVTIDNITFINGYANDDGGAINWQGPNGIIINSEFINNHATSAGGAIRW

SEQ ID NO: 115 - protein, 1024 aa, Methanobrevibacter ruminantium
MKYNKKIFFLFLLLCLIIPQAIYAGDVDDLSDAGNYTRDNSPLTISSTYQSSTYGSDGGYDDKNENIYILDKVSDGDKSKTCCSKDLSLDNACSMDKSSCSKSNSACSKGISSDKDSSNLSNTYLVSENNYNDFNVDIDLNDKLSDLDLNNDLSLNKDLTLNLNSNNDMDYLNLEEVIQTDGTLTYEGDLDQTYLNDESLNQDVQNDDSLNKNDLKSPLSDENTFNIFIISDNTGNNLFDAVACEILDNSNFSNVKFNIRSGNQINAMSEDEIYELMAPCDAFIGQWVSSNVDAVLTSLLNNHPELSNKKLFLILEPPTGNINSSSSSLNLVRNSTIDYKKIFNGISNDDLINYFKATKRGNNFESIQEYIDNEGSSFNSIFNNLVLYKDINDKANLKNELLYILYLLGHGCSYESANFTGVQASGIFRDRWYSFDEYVLTFFNESRNRTIGILESTMYIQSQQLDLVNEITERLESKGYNVIPIYCPAGNAEQLNIMVKYWTSACSNISGFLENPQDFDIYVDGIISMVAYGVGGENFTNATKFFEDANVPIFRAVHSEYITNEQWELSPVGLSTTKSDKWWHVTIAESQGIFDATYVGGVDSYISNRTGAIILTFVPVHENIELLTDRVDAWVDLKYTPNEDKNISIVYYNYPPGKQNIGASYLDAITSVYNMLYTLKDEGYYLTDLPNNVSELEDMMIACGINVANWAPGEVEKLANRSGVALLPVDEYLEWFDSLDDIVKVQITEGPVAYIGQMVRRAVLINYTDEVETMVNDWYNQIKALLPENQTVAATNILDKLVNSLKLYANASSDGDENASLYYDEFLRYYDEFKSLNVSGLNGWGEAPGNIMLVNRNGTDYFVIPGLTFGNVFIGPEPQRGWEADIENLYHCTAVAPTHQYLAAYYYMQTRQSNAMVFVGRHATHEWLPGKEVLLSYNDYGSIVVGKVPQVYFYITDGLAEAIQAKRRGFAVLISHLDSPKSYTHLYGNLTVLATLLEEYDNNHIIIESDSDKDNQAITYQVIK

SEQ ID NO: 116 - protein, 1024 aa, Methanobrevibacter ruminantium
MSFGAVSAADLNTVQSGEVSGGVDIASSNPGVENGELTYEIPDSVENIQYAGLFVDSYTAGSSNLVYGSEANITLTKNGESEQIASERLVASVGSADGEVYVINDHTTKCFADYMMTYNLTDRLQDAKGNITITVNATPIEGYTFYNKIKLIGLVFTYDDGDGDQFHYWVNAGSSWVKTDSGETSKATFKLGNVNYDPTVATLDNFALSSQDGVYTFNGKEMDESIVTETGVYYYIHHKFDILDKIKNMTNTLVYTPGEGSYSFRNVLSVVKLVKTVPVYAKVNISSEYDDIVFSGTENLLKVGITNNGTGSASYLLDLYADGKKVNSSQISLAAGREAVISLIDNTIRPSAADTVSGADNKKINYTVVVSDKNTGEVLDESSIFPNLLYNGYLGKGLAYPAEKISSFKNITVNGGMIIESLGDSTYLDASMTGKTDSWTIDLPDGAFFTDAFVYVPYNLDNGNVPMFTSTFNGAAVNPIASYRDQPNIGENAKNGYGLLVYDVGELIKAGVNSFALSKEAGIAGVYPSTLIAFYNLTDSDLLTSAFIFNGADLLSNEYNSLGRDVSSDNILSIGAFDGLVSAKLHVFAADCQAGEGDLTVNGKSYKNVWAGTNRSVGDYVVDLGKSTNASNEVSFISTASNILALQQLAVVQYNVPSVKASLVSEYSNAVFAGTNNVLSLNITNNGKFDSIYTVDFYVDGKKQNSTEISLKSGANKGLYLIDDTIRPIDASTVNGADNPKVNYTVVIIDKEKSMVLDEITITPSLLYNGNLGKDLAYPAENITSFRNITVSGGVIVDTLDDSTYINSQATNRTDIWNVNVADGDVFTDAFVYVPYNWDKTNGYMPVWNARFNGVAVSPLVSYRDQSNIGFFGKNGYGLVVYDVSKLIKSGENTFTLEKEAGITAVYPSTLMAFYNATSSNSLKTIYIYNGADLLANENNFLNRTVASDSHLDISSFKEVISAKLYVFSAGAQKGEGNIIFNNKTYKDVWNGTVNSVDSFIIDLGKSPSVSNDVSFVSTGSTIM

SEQ ID NO: 117 - protein, 944 aa, Methanobrevibacter ruminantium
MPVWNTTFNGVTVTPVAHYRDQSNMGTYGKYGYGLIVYDVSDLIVAGENTFTLEKENGTTAVYPSTLVAFYNMPESSTYVTTYLYNGADLLSNANNFLGRLVASNSTLDIDSFDNIVGADLLVFAASAQAGEGSLVINGDLVADIWNGSSNSVDAYAIDLGKNPKASNEVSFVATGSTILALQQFIVVEYNVPSAEASLVSEYSNVAFAGTNNVLQFNLTNNGALNTSYIVDFYIDGKKVNSTQIALNSGESFGQYFIDDTIRPVDASTVNGAANAKVNYTVLVSDKDTGLILDEVTLTPSVLYNGNLGKDLAHPPEEIVLFDTITVNGDVIIDTLDDSTYLGAKTTGRTDEWNLTVPSDADFEVAYLYVAYNWDKTASGMPEWNTTFNGVNVTPVAHYRDQSNMGTYGKYGYGLYIYDVSDLIKAGLNTFTLGKENGTTAVYPSTLVALYNVNESNVLTTVSLFNGADLLSNANNFLNRTVASNNVLELDFTVFDEILSSQLYVFAASAQAGEGNLIVNNETFTNVWNGTSNSVDAYIVDLGNDPSLSNDVSFVATGSTILALEQFVVVKSKYQTSSDLQKLIDAAEPGSTLDLGDNVFQDVANVVIDKNLTIKGGSIMGKAGETIFVIPAKSANGPDEVNITGVDFIVEDANVIVQATADNGSSPTSIDTPNIRISDNFIDMIDGSVVPESVTVLKLDSERGVLAPTGELKVTDNAIAAGIKPFEFDVTGVSNGSDTNIPEGGNIPAKQASVIHYQDMETTAVNSKIEGRVGKYFEVNLTDTNGNPLANKFVQIGFNGVVYNRTTNETGGVKLQINLGYKGTYTFAISYLGDDYYNGSFVVSKIKVSTQNTKLTTAAKTYKASAKTKTLTATLKSSVYNKPINGKKVTFTVNGKSYSATTNAKGVATVKVSLSTKKTYSFTAKFAGDDMYTKSSVTGKVTIK

SEQ ID NO: 118 - protein, 1024 aa, Methanobrevibacter ruminantium
MNSNKTYAVLGLLLLLILSIGAISAEDSIDDMSLTDINSADNSNINQINAIDNSIDTSTDSSIDTDNSIETNLDSSIEDKNSTDAKNTLSSNSLASTYKITEKDYLTYFDKDGNILSGKLKSGDTIDLSGTFSKKAFVINIPLTITSSDGTAKLLNSNINLVSGAQGSMVSNLNMNTSVEKTPALSAVNVTKVSFVNNTVLSTATGSYALLLNTVNNSDVLFNTFQTTCFVEGWGHPSALVLSGSNYNNISSNNVIVNDSNGIYLTGYLGGGSMGDSTQGSNTYNYIYNNTVHSVRGVEWAKDKDGNKPLPSSFCYGIQVMGAYNEIIENTVYNMYRGISATQTGNKVVNNNLSNIHGTWYSGGTNDDGADYTIYVTTNSIVKDNSISDSKIGDSTAAIHAAANTNVTNNVLSNIEGTGVLIEGNNVVCNKNSLLGLTNDGIIAKGNVSNIDISGNIINASETAVSLVKTSRSLAPHDITVSENTIFTTKENPISYEEAYSTNITVENNRIIKEASNGTDPSTEGNGTYYIIDSNFYNYFDNTGYLKSTIKENDILIFVGPIESKDKIYINNKVNITGIDAVFKDTTIIVLDDGVVIDGITINNPNEAKNDREWGIQVNGAKDVTIKNCNITIYDAFSAYAVYLIDSSDCKLINNNLEAKGDYLTSAVLLYNTNNTVLSGNSLKTIGTGQNYTFLNESCLDGCLDGCLDGCLDGCLDGCLDGCLDGCLDGCADGCADGCLDGAQGVNHIISGIFRTYGLFMVYSSNNNVTDNKVDVSSALEKGYATYIESTNAIGGIFIHHNSNNNIIKSNNITLNGNDPFMYGAGVVGGNSNHTDYVSSNNQFESNAINVKSPYYAIGILLGYNSSKSTLKSNKISLSANNYSYNIASYKSSENTVDGTVTVLKDTIVTSTNITAQSNSPIVLNLTVLDEDNKTVTVGSLLAYVNNTLVNSTSIKGQSTSLGIGAYPKGTYDLVVLYVNGGIYRVGAGACQFNVSDVINTGNGTKDIQNALDNAKDGATVDLG

SEQ ID NO: 119 - protein, 1024 aa, Methanobrevibacter ruminantium
MINKRIISLSLLIILVFLIIGLSAVSAEDSSKAADLDLNSSSVSNIDLSSNSVAIESNSNSIASESSSNIVLDNKSSDTTDIQTDSDSSSDDNLNHDSNSKIKSDNSKKVHTITESNYSLYFDSNGYLNNSLVSSNDTINLSGNFSSKYFRFSIPLTITSLENDAFLRNSPIIITGVSNENYVYDAIVSNLTIESDLANISAVWVIGSSNIKVLNNNIFTTGHNGYPIALDSFVYNCILANNTIKTIVPVSEAMSSKDIDEDNQTNNSDNSSWQHSGISLRDAHYNTVVDNDITVENSYGVYLCYGASISNYNVIANNTIRATSETPSFWCYGVYITGNYNLIYGNDFYHLYQGVHSSYPYNSIVSNNFYDIDGLDDNYGAGGDFGIYGGNNTLIANNSIYNAKLYNAGILVGTNSEVYGNYIQINSSGEGIRIGDKEGGSYSKVYNNTVDFLDGKGICLYGEPNSTLVYDNILNSISSIDSLDLSAESKGSGLGIGIYSHYQSRAKRPYNISTCNNTIYTSNDYAIDISQSSTKAYTCYGNLVFGKGIIYPMEVVYVPDYGEGNVYEVSEDNFYTYFDSSNKLSDKVKDGDSLIFVGEFSPKGKITLNKEVNLFGYGALLKNTTVFINAPNCRVHNFTIVNNGIDEYNLWGVYVFEADNASIVGNNISILDKNTSYGIYLCDSYDNNVSDNTISCQGDNLVFSLLTYEAYDTLFENNKILAIGTDELYPYYETICIDGVHSISELSKTYGVILDSSSRNQFIHNDIEVTSTLEGFHVPYNPSVNILIGLYIYYASNYNNISENNVYVHGHDPFLYGVGSSGDDTSKSVTYACENIFSHNNITVEGDYFVMGMILRHNSKDTIVDSNHFRLNSNNYTYGITLEISEGAKVTNNVLNSTGNAGIYAMELYASNNNDIKSNEIYASASYSSVALYASSNNNVTHNVIKTYGNKVQEPAQGPEHPDSVDLFNTGISLQKFSSGNNISDNIIETDGDAAVDFDETSTGNTVGNNELSSTKGGGNAAVN

SEQ ID NO: 120 - protein, 1024 aa, Methanobrevibacter ruminantium
MDFKKAIPLFALLLLILFIIGSSSAASSDLSSSPADNENLEIDSFDSNEDLTVNTNTNYIESGNNLEIDYKSNSKESVNATNDIKEETVDYNEDISVEKNNLKSSKLSSVYKITESNYSNYFNKSGNILSNVNPGDTLDFSGSFNNKDFKIDIPLTVTSSDGAQFIDCSFKFNKGSDGSNISNLNINSSRLQSPLIYLDSVSNMNVFNNNLFSCASKSYALCFSNVSYSSAYHNTLQTTAFVVGWGHPSAFVLAGANNLNISSNNVIVNDSNGIYFTTYVGDTISANLINENNYIFNNTVHSVRGVEWAVDENGTTPLPSSFCYAIQVMGSGNKLLNNTVYNAYRGISASGSNSVVAGNVVYDIKGNYYSGNTKDDGGDYGINVGPNSIVENNTIYNSHFNKNSGVAISVGSNTTVRYNNITNINGTGADLSKNFIEFSHNRIDNVSDNGIRVKGQYGNTNISDNFINSTDSSITLLRSSKDKYPSRINIENNDFYTDVSPIYYLEGYIGKLTAKDNTLNGSSISDISIDVPSSSETKVSINSTKIDFNESVLIMPTVSAYGLSLEGLVDIIVNSQKIATVPIGSNYTFTPTEAGSFSINANFTGNEEYKPSESAVLILTVTPKETTTSIIISPSTVELNDTVVISPFVRYNGTLLEGFVDILLDGEKLDTVEIGSDYSYVPNSSGSFYISASFSGGNGYGASVSDMLILTVNESSSIEDPDDPTNLTVSSILISPNTVEVNDTVLISPFVRCNGTLLEGLVDILIDGEKLDSVVIGSDYAYVPSTAGTFNISASYAGGNGYEPSVSDIVVLTVNEKQIIDNGTDNNGTDNNGTDTNGTGTNGTDTNGTDNNGTDTNGTDTNGTENNGTDTDQIKIIINDDNYSDYFDNGYPIDLDVDGNYTLIIDSLNNKDIIIPSGFNINIIGKEGSGTINNGTIQLGDGTDEVGDVKISNLTFNNYNKDAIVINEIAYDLTVENNKIIINTEASPGNLYFSVYGINAKGYVDSLAVRDNDIFLNGSAPYLY

SEQ ID NO: 121 - protein, 1024 aa, Methanobrevibacter ruminantium
MKLKKFSVILAVLLVAILAIGAVSAESVSDTDVAAVAAVDDTAGTVSVDDSIDDVSVDTTDNDVKNSLSAVALEDGESVSYEINDTSYSTYFKDDGTATDELSEMGGYTLNIGTLTNKDIQIISGSDINITAKDGEGFINNGTIILGGDEFPGSIIVSGLTFTNTNKDAIQVLDYTTDVSIYDNNMNIIGISSLSSDPNFSVYGVSANGFISGLYIENNTMSVEGDALSYGIEVGAYSDGAYALSNPQDILISGNTIDVSTSGAMAEPMYLSDVWDVTVVNNFVTAESVNAPAYGIQVADSAMWASYMDPNYDGDLSSPNNVLIDGNTFILNSDFMIYGITTINYGWDGIEMESYALPLNITVSNNNVYANSKKGVMGIAGQIYNLTVIDNTVIAIGGSAEGLYTGDLLGNGTYALYIDYDGNYAEDTYYVVVKDNDVFTNVTKEYAFNNDYERVIFENNEDLKTFVIDDETYSIFFNDDGTSDVLEDMEDYTLMIGPLNNKDIVLDSGSEIVILGLDEGYINNGTIVLDGVSDVYVSDLVFVNVNKDAFYIGDESNEIVIVDNAIVLVGKAAESTNPYFSLYAISANGYVTGLNITDNSIYITGDAPYSYGISLSAYAAEFNPEDITIYNNTIEMSLSEGSSMAEAIYLDCPSDATIEENNITIETVGNTFAYGIQVADTLPAAYEYASYRGELTSPELVTIKGNTLNISSEYMIYGITVLSEGALVNGSGDLALCQFELFLNVSENTIYADSTKGVIGLAGKVYNITMNNNDLYVTGGDASDVFSYDDLGVGTYAVGIKYNGDSEDGNYYADVFENNIFTNVSAEYINDETVLDEYVFFNNFIPLDLGIVLEADKDALEIGDLINYTITVVNNGPNAASDVYVSFELSDILLLVTAPEEYDAEFELLNVSDLAVGQEKVYNIVAQVIDGGYLLSTAYVDCYEDDTYMDNNTASLDMIAVPIVIDDSNYANYFNENGYLKDDVIATGTVVLFGNLTNKDLFINAPLLISDCKDTKLVNTTIAL

SEQ ID NO: 122 - protein, 1024 aa, Methanobrevibacter ruminantium
MILISLILVILSISCVSANDLTNDAIQGDLSDIDYSFTIDDDLSNSDNSLDVSSDLKENSCLDEIDLDKESNQNTTKILSSNQLDSNLLDSNQLESDQLSSNQLDSSLLNSNQLNLSNTYTVSQSTYSKYFDKNGYVKTSVVAPYDTIDLSGNIISKNFIFTIPCHITSSNNAKLTNCMIKFENMTADGRSSVSNLYIRNSVEWCPGVFLEGSTNVDVYGNDIYCTGANGNPVRVIYSNYSNIFGNKLETYFTGYMNLSWKRAGILLGDSHYNNIFSNDVTIKDSNPIYLTTYGFEKSNHNTIYNNTVRSSAISEDSGLSNPSAWAYGIHLMGDYNIALNNTIHNVYRGIDSEGSFNILAGNIIFNLTGGYFEGNDGTEGGDYGIHASYDNIVANNTIFNSKLTGSAIYLMPNNTAYGNIVYNISGHNGLEFNYYADNCKVYNNIIDVPVESPIYVFGRMNNLLIENNILTSVDSSSILVKKQSNSKYPTDVTIRNNLIMGYSKTFNQSPIDYSQIKSDANIISFNNSIAVYNDTYFNYFAEIGNVRDYSDWIDLNNTINYSDSYNYNALVFVGNFSSITDNITKTDYIIPLKDIVNSRISDVYRNVPYNEYKSMMETLNEIYTDIVFNGPSPVDLRGVDSGGNSSDSNQTPMDGNGSMNESSDNGSDNSTNSSLDNLDDEVKDSYENLIDNINSTENASDVYVINDANYALYFNEDGSFRDDFPIEFGNTLRFANLTNKMFKIDIPLKIISDSEDSSLLNCFISLEGESSNTIISNLKFELDNLSSNIDFISIKDGVSNVLIYNNTFKLDIDSSDSLIDSPLSDDASLSAIRLYGSDYISRNIFIENNIIDFKSNFGQLYGIYLSNKMDYLNSKTNPSGFIIRNNVFSIDSNGLINAIYSDSVKNLLLENNLFNLSSNGNLEDSSLIYGLDLVKVDNLTMINNQFSINSTYLACGINSSDSSGFNLSNNQFSVDSAYLAYGLNLKNTNNFNLHNNDFYIDSGSFAHALDLDDCNNFNIANNLI

SEQ ID NO: 123 - protein, 184 aa, Methanobrevibacter ruminantium
MDNSNIIISVIIVLCIAAGVTAYGISEGDNAVFSDLTGFSPSSTDSGDTGIGNTTGNNSQGGGITAGQTNVATNTGGSSSGGSSGSGSSGSGSGSGSGSSGSGGSSSGNGGGNTNPSPSPSKISAAQAKNIAAGAIAEEGAYISSVSDTGSAYVCYISNAEGTNVGYITVSYGGAIIEGAGGAP

SEQ ID NO: 124 - protein, 200 aa, Methanobrevibacter ruminantium
MDNSSILISVIIVLCIAAGVTAYGLTNDSNTVFNDLSGFTPDESGDTGIGNNTTGGNGNSGSGITAGTTDSGSGTGSSGTGTGSSSSSSSSSSSSSSSSSSSNTQQKAWKPKVSPEKAKALATSAARNSGWPGAYCYSATYNSGGYYVCLLKDDAGNTGYAHIGSGTGRFLEGSWSKQVTKEPNEVEDDYKENETSNITE

SEQ ID NO: 125 - protein, 519 aa, Methanobrevibacter ruminantium
MRKEILIAAIAIILILCGGVFAASNMQIADIATFSLNAIDLEDRGSLIVDSEDITASKGYYNSSASDENVVLVKNYSLRLSNSIVNKTGDTGSSGDDADFYGINSAVLVNSNGSVELSDVEIETNSKGSNGVFVTNAVSDSNSNSSSSSGSPIVDSTERHDGKSDAEEPGGVPPEKPVEDGPSVYGGSSGGKGALSDGNQSMPAPGASSSDVEGSSSADISNVRITTHGDKSRGLDATFGGKIIASDVEINTDGQSCAALATDRGEGEVHVKNCILNTGVDEKSGRGSPIIYSTGNITADNSEGCAHVSQIACIEGKNSIALSNCEFSAGAGGNREDNGEYVDLGGVFIYQSMSGDADVGTSLFDANCCVLSIEEDSEYYKTAPMFHVTNTKAIVKLASTELNFGSGVLLNVSGQSQWGTVGSNGGELEFDASDEILDGDVFVDSISSLNMSLASTSFIGAVNPDDDFGETNLVIDSDSDWTLDGDSHLSSLENNGDIDYNGHTLYVDGKAYTESNPFK

SEQ ID NO: 126 - protein, 1024 aa, Methanobrevibacter ruminantium
MLISIVLISLIALGAVSAADDVAADDAVAPATVDEVQTIDNTITNDDISYESTDIIVNDTGDSADSKAKTTSLSANAVNEGETLSFTQLAADVSSSPSMLSGAYYKYDPSTDTAFENGITLTNGLTIIGGGATIDGDNQARIFNIPEGVSVTIMGVTLINGAADEGAAIYNSGKLTLMNAKVNDNTAVKSGGGIYNNGGEVLVTSSEFDGNDLTDRTVNGYGGAAIYSNGGSVTITDTNVTNNLKNIVHRGGTGTYTGDLSSAAVTSNNADLTVTNSRFIANSGSYGGAIYSGESTSANLLVSGSTFEDNFAFNGGAIDIVGTSYTISDSTFKNNNVKGTGSTNSNYASGGAICVQDANNPGLISGCDFEANSGVVGGAVNCENTMVLDCTFTDNTANSANSETFNGKTNNRGGFAGAIYNEGTITISDCEFDDNAGRGEGIRVKNAEISDSSFTNTRIDTCQNSNVLLTNNTYNNPDRDVQAASGTQVTVDVADGDIPNANTAPYIVGDLTFTDLQALIDSGSSGIRLTGNVIKTAEEETTFADGLNVDKTVTIYGAEGKVIQANSGKIFNVAEGKTLTLRNATLQGSGETAITNYGTVYLYLADNNQFTDCGDVLIDNHGRTTETGLTTFTQLNNLIGLVNGGTVYIGESKITKAEDEKEAYKNGIVIDKDLSILGSYNTYYKYVKTSINANNDGRIFTVAEGKSLSLKYINVTNGAADEGAGVYVSEDATLIADTANFIKNTAVTKGGAIYSEGTVDLTNVNIKNNTISKTDGVMADDNGGAALYNNGGTATLDKVNVTDNQKTYVIGDIMDGVVVSKGATTITNSYFANNSGRWGGAITQTGTDQTLTVEDTIFEENTAIFGAAIFDNSPLVVKDCKFYNNSAIGPGSPGTSNSQGAAILVMDDTASADISGSEFINNTADCGGAVSLAGVGSDSSIDDCTFIDNTAYADGGAVYFWTESASVTVTDSEFISNTAPYGGAIENEGLGDLIVDGCEFTENTASLRGGAIISSGDTSVSNSK

SEQ ID NO: 127 - protein, 137 aa, Methanobrevibacter ruminantium
MKEIAIYLILIIIVLIAAQHLNVVVSGSMEPVMYRGDIVVLQKANLFGIHEFDPHDVQVGDIVVYNAAWYDSPVIHRVINTAEINGTTCFEIKGDNNNKSDPYWVTPEQITDRVITINGQPLVIPKIGYITLWVKGL

SEQ ID NO: 128 - protein, 132 aa, Methanobrevibacter ruminantium
MFEAGMIALPTGLPGLALLGLGTVLTAYGSGMFDDLGTDHPGYAKPENQLNFGLSMGLNFIGLGASEGLARGVLYKEVQEKLVTGFVPSIKAYGKTIMDESLGKGNAKISTVIWAYVENSVILAIENSINGG

SEQ ID NO: 129 - protein, 152 aa, Methanobrevibacter ruminantium
MKNWKIIGLILIILLAVVSVSGCIGDDSSSDTTSISADALNITEDGTYDSKEEVAAYIDEYHKLPSNYITKSEAKALGWHGGSVEKYAPGKCIGGDIFSNRQSILPIGHEYKECDIDTLGADSRGPKRIVFSTDDYEVYYTGDHYASFEHLT

SEQ ID NO: 130 - protein, 1024 aa, Methanobrevibacter ruminantium
MVQNTNLSNNTAVFNESRNETSGIGGALDVVGNNCQIINVTSDNNNAYRGGSTFIRGNDTVIRNSTFDNNNATLRGGGLNIAGEGCTIFNVDVSNNAAGENGGGIYVIADGTEFRNITADNNTAERGGGAFVEGNDIIIDNGTFNGNKAIFNESKPDESGIGGALDIKGHGCNVTNVDSFNNTAYRGGSTFIRGDNTYLENCTLDGNNATLRGGGLNIAGENCTIHNVDISNNTAGLMGGGIYVIADGTVFRNITADNNSAERGGAVFVEGNDIIIDNATFNDNKAIFNESRPDDSGLGGALDIKGDGCNVTNVNSFNNTAYRGGSTFIRGDNTHVENCTLEGNNATLRGGGLNIAGENCTVYNVDVSNNTAGLMGGAIYVVANGTEFRNITANNNSAERGGGAFIEGNNVTIDNATFNNNRAIFNETRPDESGLGGALDIKGDGCNVTNVNSTNNTAYRGGSTFIRGDDTYVANCTLDGNNATLRGGGLNIAGDRCIIDDVDVSNNNAGLMGGGIYVVSNGTEFRNITADNNTAERGGSAFINGTGITIRDGELNNNRAIYNESRPDESGLGGGFDIVGDNILVDSVHSNNNSAYRGGSTFIRGSNVTVQNCNLDNNTATVRGGGLNIGGGDGCKVINVSVSNNDAGEDGGAVYVIGDFSLFDNVNSTNNTAQRGGSSFIAGNNVTVINCNLDNNTASNRGGGLDVNGSGCVFENVTLSNCHADKEGGAVYVRGDNVTFNNVTSENNTAERGGSSFVAGDNCKVINCDLNNNNATWRGGGLDVTGTNCLFENVTLSNCHSDEDGGAVYISGDDNRFVNVTSVNNTAVNYGGSTYIGGTSNSVENCTISNNIAYNGGGIFIEGEDSKFTNNNITFNKAIATDEDHDFNIMGGGVFILGGNSNFTNNNISSNHAKDNGGGVQIFFGPDTFMDKIYAFNNTAENGGFANLLYCDNLNVTNSTFYSNHATGDISLDRGEGGAFHMSYATNIDVQGNFSYNTATNGSAIYSDGSDIRVHDSSFFDNQA

SEQ ID NO: 131 - protein, 1024 aa, Methanobrevibacter ruminantium
MRNKKIFIFTLMIVMLLSLAAVSANDLDNLEVDDGNVVSTDTVINDVPMESTSSDKIALNVDSTQSNTTEILNENEIITNNSTLSIDLNESITNEISSDHEDSYQADSNQEDSYFTSDGNIYVKVKTSMLKADGDQIYYIHPAGSPTATGTRDDPLDSMNSALNLFTSDGTHTIVVMDGIYKDTYYDYNNTDVDTNLSNLIIKSDEGASPHFNLSTSDYRRSLYWAFTGENITIDGLKFTDSQYGSFNEDGVYKYHTVLRFINSTNVLVENCVFDNDGYLINATDSSDVVIKNCNVSNSNRSNVFNVLNSSFTVQDSNLSKIRDSYITNSSFKLINNTICNNVNSNLFTVKNSSLDIINNTFKDSNYSSYYVFRIYNNNETYANFTGNNFTNLTGTDYLLQVNYYVNDNTTVSFVNNSLKDVSLGLNIRYSNLTMDGNSFDNLSLSSRPSYSGISTSYSNVSFTNNNFTNSDSYIYLGYGVNATIENNNFTDNIPSYYGLLRAEGNSHDIKENNFTNNKGNCSIIQHYSGNATIHGNHFYNNSLNGCGHVINVTSTSGSEIYKNDFVNNSADNGTVYLYGSSNVHDNNFTNNSVTGLGGAIYSYSFYNINTTIKENVFDGNNASFGGAIYYENYPSYNNKREIVNNTFINNSADFGGAIYSNKSINNIIDDNDFINNSAQIGGAIFVDYLYINDFRYNNTNNTISNNLFAENNAQSGGAVVLYSQNSTVEGNRFISNNASRYGGGALITSGNNSIIVNNTFANNTAQLYGGAIGTNDSKIIDNKFENNSAYQAGAILTINSTIHNNDFVGNEATRGPAIVYIDDFNYTALTYYTYNCSCENCSNCSGCSDCECCVTTIVDPETGDEIKIINCSNCDGCNCTCENSTVTEHNITLLYNNTGIDIDEDVYAYHENQLLRVAKENNGMYYLYDNVNVTSAENYTYWAYCIEQNNSYPWLGNGTLGVHVDDLYFVRNSLDDSYVGDYLKILISYFYHNLDEDKINVKEYIYIFTDTDYRSNNDRIIQK

SEQ ID NO: 132 - protein, 1024 aa, Methanobrevibacter ruminantium
MSIKRILLTSLMLFIIIFSISFVSANENVTNDVSTNELSTQTVSNDITTSESISDTSLDSGENRGLDEIKSNSTEESSSSNLDLEDGTLNNDEIESDDCLTKNGKEATLQANKLSLDINMSRGTAQDVLDAIVRISSQGGGTLYLNGGTYTEGGHARVYNNDTDSFRNIVRNDGIVDISNVRVVGGSVDNPNQYATFQPNTRDSTSLAFSGYGVWDGNGTRYYPDSGFNLTNVTFENLNCTGRFFSFNSGYLTDCVFNNLESYQHLFFVTGAYNDGGKPIVLTNCNFTNSKQTYRGDGPGDGTDGTGQFGVVFGAEMYGCNFINTSTATHGGAFCLSDEWISAACVPSKLVDCNFINITSRWFAVYIHGNYSNTTRFITEPQVVENCSFINCTATGEFGGALGISHNNVIINNTEFIHNVGGKGSAIMVGGINNTHDGFLGVNTQGNNITIYNCTFEDNIAKIEGQSSAHSTDPPFTTYPTGYGGAVYVYGNHTKIIDSTFNNNTADDSCGAAIYIRGDNTTVVNSEFYNHTSENGTIYLVGNDCKIKDSLFHDNDADSTGACIFVEGNRAEIGNTTFVNNTAPNGGCVFIIGDHTLVDNDTKFITNNATNGAGIYVNGSNTMILNTSFINNTAVNGSGAFIYGHDTDVNGSYFEGNDATNGGAVFIEGNINDISNNTFLRNNATNQGGAVYIDGNHTKVNYNNFTENEAIPISEDQETGLGGAIFIRGNDTNTTANTFLHNKARNGSAIYTDGTNFYLHNDHFLENQAWSYLLITTADPAESLYKEQDIEINVLYRAGDNIINAIHNRNKPNETHFMNVTYSHSEFGNITTSPADQYVEPVDGVENSREGELLYQDDRENYQQIELRVEHENGDLALPRTPFRTNIYGNVNTTLNKSSLRKGLYVVGAEHIEDWNYKFIMNSTSFRILDTMDIMVNKTSDKEEYFQDEIAEWELIFHNTDNGTDAENVTMTDHLPNVFELMNLSYMFYTPTEAITNATLYLNNNTLRYGVYNSSSQQWVYGDA

SEQ ID NO: 133 - protein, 323 aa, Methanobrevibacter ruminantium
MDKVGIIGAGSLGTALAQTVANNVDTVYLHLRREELAKTINSTGYNSEYYPNTKLKNNIIATTDMNDLIDCKIIFLSIPSSAFRSTLENLKEVISEDTILVTTAKGIEYPSLKSMGRLIEEYFDENFVALSGPNFASEIVLNLATVSNIASRSSENAIKVKKVLSTPEFKVKIIDDVVGLEICGVIKNINAIANGICEGMNINENARYAVLTKGFEDTGRIIEAFGGKISTASEYCGFGDLVLTSTSSESRNHTLGMLYGQRIIVDEKASGIVFEGKNSIMAIKDICNNTNTNSVVVNFVYDVIVKQIPPKIAFKDLWNNIEE

SEQ ID NO: 134 - protein, 363 aa, Methanobrevibacter ruminantium
MMSEDSILLTIKSFTDLQTEINNTANGGILILEGYYKYNSNLDSNFLQKGVLVNKNITIFGNGCVIDGNNTSSLMEINANNNTVKIYDLNFINGHQNTWNYGRVSITNSIAYFNNCSFLNSTNGYYGSVYIAKTSQAHFNNCIFNNNYAKFGGAIFNNNIMYCKNCSFENNSAQSGGSLCINGENNGVENTNNYTYLENCSFSDNSSTAHGAVIYCDEWSKGCFNNCSFEKNSATTSGGAITIDGANIDINNCSFNKNKTGTSSTYNGGAIWIIKNDISGASNVNILNTSFSNNSASQDGGAIYLNGTCVLKISNSSFNNNTATRYGGSIRNYQGTATAYLCGFLKSSDATYGTITKNGCYGP

SEQ ID NO: 135 - protein, 87 aa, Methanobrevibacter ruminantium
MICSIQACSASCTAVYVGPDVSADGSTIIARCNDHQGVWGNHITVTPRVENKSSRLMAVCEDGSVKTELPATTYKYTATPYMNSTKA

SEQ ID NO: 136 - protein, 261 aa, Methanobrevibacter ruminantium
MKISRIILILLLFVVFFEIGLFSSYTIVNAEVPNPQELWDMQVNTVSSFFSPENVGGLLIKDPDNINVTNKYDLATELAEVAEVDGVNVENMTITTSADTDEEPFNATVTAFGYSTPKGNSGSIVISGQPDYKIVASVQIKHTINGYEADLDTINIESILKVYDSNDAKNVSYSGYDSGPSGASQSYSYSSDSSSSNDNAYISSDSSSGSSSYDSGASSSSGSYSGGSSYDSGASSGSGSSSGSGSGDVVINLLSPIFSFI

SEQ ID NO: 137 - protein, 741 aa, Methanobrevibacter ruminantium
MILIISLFLISLLAIGAASASEDITDTIEAPAADEVVTVDSEIQEIETVDNNLEEIETDTNNIEEVEAADDEVINETAETEIKDETEITDETIISEEKVQIANDEKIVQDGLLGFSINLTDLLGGESSSLNLSKLLSGDNLNLNLSKLLSGDNLNLNWSELLSGDSFTLNWTDLLGGDSLTVNWTDLLGGESTTLNWTDLLGRDSLTVNWTDLLGEDFTLNLTDLLGRDSLTVNWTDLLGGDSLTVNWTDLLNGDSLTFNWTDLLGDNLTLNMSSLLGGESTTINWTELLGDNLTFNMSSLLGEDFNLNMTSLLGEDFKLNLTNIFGDNLTAIFGENLTNKLEELFGDDFTINMTDLFGEDLALNMSDIFGDDSIFNLSNILGESTTINWTDLLGEGSTLNISKILGESLTLNLTDLFGESSTLNWTELLGGESLTLNWTELLGGDSFTINWTDLLGNSTTINWTDLLGRDSLTVNWTDLLGGDSFTINWTDLLGGETLTINWTKILGNDTSLIDNITSLIDDISPFVDNLTTAVKDLINKFLKEEKTVSVINYEDMTTTAFDSKIDGRIGKYFVVKLTDDKGKALSDKFVQIGFNGRIYNRTSDENGTVKLQINLGYKGDYTFAICFLGDEKTNGSFAVAKITVKKQKAKLTGTAASYKASAKNKYISATFKTTAGSPIAGKKITFTINKKTYTAKTDAKGVAKVKVSITNKGTYAFTAKYAGDDTYATITSASKKLTIK

SEQ ID NO: 138 - protein, 1024 aa, Methanobrevibacter ruminantium
MKLYKNSIIILLLILILSIGAAAAVENDYSNADLDISNDFVLSDNSNEILIDSSGSLDDSSSALVSEGSSNGLDSYYSNDLVLNDSLSSRSSVIEDSCSIDSTTIEDKALEKSLSSNELAEGTKTYTDLLKDIKSAKNVLNLKYDYIYDSTIDKSLKKGIVLTFDEDYELTINGNGHIIDGNGIAGGFNFENGEFVINNLSFQNCKISSLILTSCDFTTNYVTFSNNYDKSSGACVYLDNSYFYSSHDNFIDNYAPSGSAIYGECSVIDVYDGLFESQKPIDWSFIYGWDETEIYIEDCLFRNTVSNYSTAVYGDYIIEISNSHFTNLFSKFTGGAIGVRNASLTVEKSEFNNVSSLRNGGVIYADMNVDEEKSSEETIIKDSSFVNSKSDFGGAVLQLGGKLKIYRSNFTENTANYYGGAIYTSNVSFYTSKSKFSNNVANEMKGSAIYFDNGDLKIENSNVLSNPSCEGAIYIYDSFYNISGSTFSNNDVAIHSFFDRTRTVKNSKTGKSTTVKSSLNNNTWGGDRNKLNNVEYPYFVSNLGQDIILNPVKINATIKDKYFNLVDLGLVTPVKDQGDSGACWAFGGAAALESAILKATGVSLDISENNIQSAGLRYSLYGKPSLTEGGYDYTALAYYLSWLGPNNSSIDEYDQFGKISPQLFSEDNYHILDVIFLDPANTSSIKDGLIKYGALSASANGADSDSNDFFNEKTYAQYCNDDEASANHIISIVGWDDNYSKNNFLITPKGNGAWIVKNSWGSDWGKNGYYYISYYDESLRSCYAVAYLLNNTLRYNKLYQYDLTNYDDFDDGDYDGVIYSNKFTSNGDDLIAAVGTYFEYEDDDYVISVYVNGKKAYQQKGTSAFVGYNTIKLNKYIAVNKGETFTVAISSSAMPYVDDTRIHLPKGSSFLTVDGEQIDLSQRGQIACIKVYTFNDTKITRDQSTYYGSDKKLAIESELEGTTISLTDSNCKSLGSAKVVDGVAQFDLVLGPGTYFYTSSYAGEKIINSFKVFSTIGGVSNKNI

SEQ ID NO: 139 - protein, 395 aa, Methanobrevibacter ruminantium
MAVILIILFSLGTVAASENIVIDESSDSNLVIDHAKDNYLFNGPIKDNYLSSSSISDNYLSKGVLDDSYLSRSDLDDSYLSMDDGKGSIDLTNHNQLSNSDDKQLKTSNLEDEKQLESVNKGDKLLKDSNDNVDLFINMDVKTSLTNKQYNRAGSEVPWIITVSSLNGTSYNTQVRDVLSENLQYLSHNATMGTFDPENGIWTVGDLESSKNASLTILTRLKRDGTYINKAYATTDSNDVNLLNNFLIISIRTGSSKITSNITETSDEREGIQHNVHYASMVDTDFIYRYEEDSSEDDGGNEEGQSEGNSHTKTRSLGNKLKLFNAQNIDYHSLSKNIGGALGFGYNSNGGFLNSKDIYEALFVYDYTRIPIIVFAAFLVVLASIVGYDKVKSSK

SEQ ID NO: 140 - protein, 1024 aa, Methanobrevibacter ruminantium
MVLVIGTISAVSANECANDLTMEISDDNIAIDSSSALEGDDLAIDSSSSDLSNENNINSMNDSVINSNSINSDSINSDSINSDSINPNPNIDDEINNHKDSFLKAVQASKTGTFTELQTKINKASKGSTIYLDKNYLYNDDFKGKYGIVINKSITIDGKGHVIDGLKKSNLIFINDASNVVFKNIIFRKGDGDENGAINLIGSDHIEFNNCSFNYNYGDRGAVFLSGSDYSSFVNCKFNENIGENGGALILADSDYSRLVNCIFFGNEASDGGAVFITYSDYSYFFNCTSEGNSVDYTGGAFYLDYSDNSSFIDCVFDTSSAKDGGAFYLGDCHNSSFINCSYWNNQVDYYGAVCYLDNCYDSSFISCNFTGNSGSNPELDETPSIGGGVFYISESHGLYFTHCNFSENEAKNDGGAIYASDSDVHIDSSVFEENCALCGGALYAMNSDIFIDSSLFESSVGDRGGSIFANKSNVYSKNSSFIQYYEIEDEYVYIPASGAYHLMEGNIGGAIYSLQSVLNISSNKFNNNFGLTSGGDIYSQYSMIYIDDCSFSNSFSNGFGGSLSFNNDYVQITDSSFENCSSRDNGGGGIYSINSILNCSDSDFTNCYSYFGGSICSLNTDLSINNNNFYKSSAEYYGGSIYFLYGTLDINGSLFSNSYGQYGGSIYIRSPQTIKNITNNQFLFSQGIRGPRIYIDQYYGEISNSGNVYTDEYEEKGLFSDYGMGISFESNEGLVPLIHYYPSNESLPSFYDPRGGGDSEDDYEDEDDDSDIAVKDQGIGGNCWAFSGIATLEACLEKVTGEEFGFSEGNAKNLMAISSIYGLNIDTNNGGYDTMFLAYLASWLGPIYEEYDTYNPLSSLSIDLPSVFHILDIDFLAPRKNSLDNDEYKRAIMNNGAVSVTFDWVENKVSNGFHSVSIIGWDDDYDDIDSLGNYAKGAWIFKNSWGYEWGDGGFGYLSYKQKLSEEIAPYMHAYTFSFKENDIGYTDIYQYDFSGLSDFLILNSTNAYYKNKFIAEDNEFLYA

SEQ ID NO: 141 - protein, 155 aa, Methanobrevibacter ruminantium
MRNPKDYIMKTDYLIILMALLLISIVSPIAAADSFDFDIPEGYHIENASDDFVLLENEDYYSISISIMDNSTDRKTLMDMLERHRCYDFRNGVNYTKGDFYIEEKPYYQEFQMGILYFCENGRDLVVIDYKGPLGMDLNNSPIDGILDSFKWVSY

SEQ ID NO: 142 - protein, 156 aa, Methanobrevibacter ruminantium
MNNKKIFVAGLAILAIVLMGSVAAVDMGILSGSPTKFSIDGIDFNIPQGYAVTDNYTRVNDTDTAGSSSYRVTQATFENNVHDAISVLVADYDHDMSEDIISQRGNKTTINGVDGYMQTQGDYTTFNYLVDGNLVTITLTNADLLEDIIVGNQTDD

SEQ ID NO: 143 - protein, 1024 aa, Methanobrevibacter ruminantium
MSEDIGINDNNGALIADVNFADDNNNALKAESNSASQNDASIDESANPTQDLVDTDNGLNQSITKSPLKSNTGLTVTKTIDNSSNHMPVDGFYDIGDTIYYTINITNNLEESIGNISVVENFPDGLIWEYIWFADDNPNWKNESNVFNYTKALEPEHSILLKIRMTGNKTGTYINTINVSSNLTSSQEFLSEEVTVYAPNLTITKVANDPIVTIGEIANFTINVTNNGNRPLSNLRIYEDPEESLFLNEFTNISGNWDSFANRGGDYGFSLDQLDIGESAAIIVSFLTTEIGNFTNNVYSNYPNPQVEANATVTVVPRIEKTVNATEIDMGESVEYNVYIDMTGANKLGIDDFKIKVTDILNEYFDLDKDSISSNWKYNRDEKAFEYMLSDIPESFEFNFAVYITERGNYTNTVSLKIGDLPEVSAESDVTHVRISDANIAETALDSTVNLQEQAVFIVNITNTGDKTFNPYELVVNDDYDEDALTYLSHEDITGKWIENIETDSLSFTLNSTLEVGESASFKLYFNTSKVGSYSNYVYININDKEDDSIVIVLALMNKSVNSREIDAGDSVEYNIFINLSGYQGPVKVEDLFNDTFALDKDTISENWHYDETENAFIFDLSDNPDTLNLSFNVTINEKGNYTNLAKLILSSDYPEITAEAPEVCVYKPDMTVTKTVNDTEIYIGDTVKYTVTIDNTGDRTLTNIIVKDELDPAFILDESSITEGWTYNKDNSSFTYNNNISVGESAILEFIVEISKEGKYTNIVNVSSPGVANKEARSEETVAKTIPTNICLENVTADPDSFVRIIINITADKGLINGTVNITFPDGTNEAVEITNGIGETVWYVPDNYASGNYSVFAYYEGNGTYLESEGQGNIEVIPYYTEISLSNVTAYPDSDVEIEINITAGDAKLINGTVTVSFPDGTNKTAEIINGTGNVNWTVPDDYKGNYSISASYPGGGNYLDSNATANIEVIAKISTQITADIPNAYPGEEIDISVNVTADNDVPFNGNITVNLPDGSKETVE

SEQ ID NO: 144 - protein, 325 aa, Methanobrevibacter ruminantium
MDFNNFKYLDELIHSGAKEINLDSDIILEDKEEQKYSDGIKLNIDNLVINGNGHIINAKEKTRIFYSTAQNITIKNIRLKNGKTNTIGGAIYNLKGKIKIIEATIKENQSKYGGSIYNDEGEMEIIKSTFTKNNAKSNGGAIHNYKGKMSIEESIINENTAKQGGAIHNYRAILSIENTTLRKNDAKDFGGAIFNDGNELKITESTIEENTSSQGGAIYNNIGEIIIKNSTITKNIAKIGGAIHSWNKLSIISSTLNKNKSYEYGGAIHNFDGEIFIKDSIITENISNKGGGIFSNNKKYKITTSTIENNESDNIHEIDSFLDMD

SEQ ID NO: 145 - protein, 365 aa, Methanobrevibacter ruminantium
MSKSFRDLELLIENCDDEIVLDSDIVLGDGEGPIYLEGINLDSDVIIDGNGHSIDACGKVRIFYSSGELTIKNISLLNGYSDESGGAIVVDGGKMDIIDSIISGNYSADDGGAIHIEEGELALINSTVKENKAKEFGGAINNWDSLKIVNCEISSNEARFGGAILNNDGNLEISDSLFKDNKADKGGVIYNQDGDFSVEKTLFEKNKASADGGVFYNENCDISVIESKLNDNQADKGGVIYNNGVFIIKDCELINNRANDGGSIVNYEAELNVMGSSLSGNLSNYGGAIYTYDGEMSIDESRFDDNRAECGGAIYSEKCIWDVSNSEFNSNKAKNSGGAILLKKSKYEVDNVSFRDNEPDDVSNF

SEQ ID NO: 146 - protein, 604 aa, Methanobrevibacter ruminantium
MDFREELNKILKSDDEENNNLKSTENKIKDKKEDNNLKPIDNKIKDKKEDNNLKPIDNKIPNENKEPKEKKTPQKTDEERMQNRPKETIDHLKRFKELNTTTDSIFNISPYQVLIILKDGTNITDWKEIEDKKDILYISEDLSGESYISNKYRDLEGMRLIIAQGITSKVQFIESMFADCKSLIDVIGLETWDTSNLLSLENMFGGCSSLTSCDGLRYLDVSNVNDMTALFNDCYRLNDIDSLKEWNTSNLTKMWSMFAGCKSLKDLRPISNWNTSNVTNMTSLFTECESLNDINGIRSWDSSNLKDMGSLLWGCKSLTDISALSNWNTSNVRKMGRMFWNCESLTDISPLKDWNVSNVEDMVYMFVNCKSLKDLTPLSNWKPSKVIIMRSMFDGCSSIESLNGLENWNLENVTTVERMFDRCKSLSDVSALKSWNLSNDVIAGGIFNECPNVKENPLKKEIKDKNKPLHHIDLNIKFLDIYGTGWCLVKLGDIYSRASYITDVPYDCLSSIVNAIKNDENFHVDFNGEGWTFDVEADNEQCYFNFHGGEKHAFDTMNKYDLAIVIYRNIRDNLSSWKGWTHRDLSPLLNELCSLINENEADEN

SEQ ID NO: 147 - protein, 628 aa, Methanobrevibacter ruminantium
MAEMTIRNSIIENNSARNGGAILNDGNLFIEKTTFKNNLAFTAGAISNGGYVSLKDVSMENNIAVTGAAFINGGDAKIEDSFIIKNIAIGEKRGMNGEHDVGGAVGNSDNLLLKNTSFINNSSPFGSAIYNLGIDIPKLKYLCKIKIEDCRFENNSSHISGEIHNEIGEISIDDSKFKNETAKRGSVIYNDSYLTITSCDFKDLKKIVHNFNLMTIHSSNFESNQSDSAVIENDGEIGILSIEKGKIANNISDYTTVYNHGKDCNITGTIFENNHSKKENCHNICNRSNMVLKEIILKDKTVSIFNEGILTAEKKYKNFIFSVGKVFYLGMENEFNFSYLDELIHSNISDTISFDEDISLLSDEFDFYEGGIELDRDNMVIDGKGKTIDASGRSRIFLVTGNNITLKNIIFKNGHAFDNYFMSNNEGGAIKVYKGLDLKIENCKFIDNISESKGGAINNKGHLTISNGLFESNKSNEGGAIYNHQKLSIIDTCFKGNEGHIGGAIYNKEDLEIVSTKFLKNIVKESLFKARFIPILQLEDESFGGAIFNKKRMVIKQSSFKKNMGLDDTDGAWGGAIRTIGDEEVTIIQTEFIGNYLKDSNFGGAISSYKTPNLIDCTFSDNYPNDLN

SEQ ID NO: 148 - protein, 1001 aa, Methanobrevibacter ruminantium
MGFIDKLKKGIGRKNKEKSSKRDTQKDTGLKRKSPPIDKASFDGSDEEYKLFESIMSYRDEPVVHSILRKISDDRLLIEIGKSHPFLELRRDAILKIKHASREDLIELFDLNEDRWGIGLRNAIASKFTKEQLMEINDERKLREIIRYSNEENANCIYDKINDEELLIDIVCLTRYESIRDKFVERFKNDPEVMRRCLESSRSPELKSKVAQYINNDKELKKYILSQNDWNNTVEYALNEMKDEKIANEALYEFAHKGKNQLNKSIEFMSDDETLLNIALEYYNLDYDRYYFEIGMALDRINDDSLLVDLMHNETDETLRRLAAKYIKSEEALKEFVNDPNENVRKIAIRATCKNSLDKFMDLFNNDEIILDDHFILDGDGIYETITINRDNVTIDGKNHKLECINPKIELRIEANNFSIKNIETNMLIRLNEGSLNISNSIIDKSIEINEGNLTGENSTFDRRIKNINGSLNLTDCNIDQIFNESSLSLKGCIIGSIKNDDSCNIDNCTINEFLYNNGRCKIENSKVESASRNYSNPYDGGGAISNGQNASMELTKCILAKNSTDKNGGVIRNIGSINLYDCIFEDNKAGLSGGAIFNEGRLTASRCKFKNNLVEFPRYGSFSRATGRYHFIKHGNSILNLAFMDLFNCQFITDKINDAPEIIAQFGKDSYLNIENCQFSTNKKTSVDAIEGGLNFNNAKFKVSFDDVEEINLANEGPEETGSINKNLKETSSTNEGLKERRSTNKGLKETSSINKGEETTVSSKNEDIDAESILENFKGFEYLDDLINDGSSEITLDCNIQMHELEQAFYEGGIEIYEDNLTIDGQYHTIDANNLSRIFHITGNGIVIKNIKFKNGYYYQDYFDNSKDGGGVLCITHSASAKIINCEFSNNESRQSGGVVKNNSDSLEIIDSNFRDNKVIYQKGGCIINNASLTLRNCSFKNNFSNAGSCVFNSEDSSLKIFDCEFNNNTSRKDFEAGGVRFSLEVPSSGGAIANEGSL

SEQ ID NO: 149 - protein, 439 aa, Methanobrevibacter ruminantium
MPLRVAVAYIFENDIDYHVNYQTDLTCLAGFDQNYTIYSNEFTSKYDELIGAVGTYFNESGIKYSFDIFVNDKKVQTQNGTSEYAGFRTIVLNNYIPIKSGDQFKVVFKSNSVPYQAWSRVHYLNGTSLVSADGSTWTDFAPLNKTVCLKVYTLNDTTKLADANDMIIEYGEDSYFSVRAATENNISVGPGEEVTFTINNNTTTVKTNDEGVAKIKISEAPGTYKITSSYNNQSYENNITIISRERTSTRILYQNMSTVAVNSKVDGRIGKYFEVNLTDDEGQPLNNMPVQIGFNGAVYNRTTNATGGVKLQINLGYEGSYTFAIAFLGDNKYAGSFEVAIIKVSKQAPKITAPAKTYKASAKTKTITATFLSDKGHGVKGKKINFVINGKTYTGTTNDKGVASVKVSLNKKGTYTCTAKFAGDGMYKATSTNFKVKII

SEQ ID NO: 150 - protein, 689 aa, Methanobrevibacter ruminantium
MEKTMKSKLFILLIIISILISISSVSASELQADASNIDNDYQTNMEFDPICNDESNQNQDLNLKNNNEHILKEENTNPPEIEDETCFTTLYQEINQSDDELNLTHDYIFNKSYDNASLYQMYYGPLISVNKTNFTINGNGHIIDGNEMGAEFDFENNKGEIVINDLTFKNFNQTVLQIYGKLTLNNVNFTESFESLESIIFVSKGVLNVNNCSFYSNRAKNIISGSQSNITVNNSIFSGNGNYERAISANRWQLVIHNSRFENFTFKNGAIIDFKGYYLDLENSSFNNIHSNLSGGAILGKYFPAYIKVANKTQYLPSDPMIIKNCRFENISCLNDGGAIHFDFDSGSQRIAQSLNIIDSNFTNCSSKYGGAISILGGGLNLEKSNLLNNYASFEGGAIYSSWTNINITDSSIKNNKAEKNAGAIYFDKGNLSIKSSDIINNSALEESPTTANAIYAHDVAADFSDSTFDNGGIAVYADFASHSNFTNVNKNDDIFLMDNHNYIVSVETPGIKLNLTNNEIIVDSLPSKFNSQDWGWTTPGKVQGDNDDCWAFATIASIETGLGKSTGVLYNLSQNYVQKLQLKYYEVGDLRNSLTGFITSGLGYALSWYGVLPTDAAYDDRGMIADSDMNVPRIHVQDAMFIYTGENNTIDQLKKAIIKYGAVTVQYWAYREGEEILSEGEDISIMET

SEQ ID NO: 151 - protein, 972 aa, Methanobrevibacter ruminantium
MDKKIFIVSFILLAIFTIGAVGASDVSELTANDLDDNALSLNDGEDLLAGDESGESGKESYFNNDNNYNDENRVNANNLDYGAGDNDASKDKVLSDNVSDYIYATTLSVSVDDTPQSQYPTATVSLNDLSGNPVAEASVSVSVDGDDYMTVITTTDGTCPLSLDNYLSVGSHKVGAEYSGDGTYGPSSASTTFNVLEEYSSYLNTDLFIYTGTGREGGYTSVTGKLTHINQPISNATISLYVDDDFYSNLTTDKQGEIEGMLFNISVGRHELRGEYVGDRGFEPSNATKYFNVLPKDSVSSNIQMTLNASDAQVGTQANAYVLLERQYGGPMEDATISISVDDVFYMNVTTNALGYAFFDLSDDLSVGSHKLSGEYPGNEYTGSSSASITFNILPVDDSSYNFTVTEYANYLDTNTTVLDISSKYYVNGSFNVSVVSPNGTLSTFTQDCSPDGHNNWSMADFGIDGIGSYIISGSLIFKNETLTHFDNQTFHAICIRPIYMESTEANNPLDILVVYNSSDATKVSVNGSGLFEGRKITDGPIVWNLTDLNITELGDYNISVMSYDSKGNLIDRFDYNLTIGPNGDDYKLYAKIDPNSYSTDDVAVALYCPNASWGNDIEVHIYMGNPLEVLTFFPDSVSPTEAASFKKYTLADLRIENSNDYRVEIKDFALNQFPGISFNIKVCYSNMILVSGNGSFEIDFDGASVNATLTDSNGNPISNASVSALVNGVESNCTTDDNGNLIIPFEGNTTVKLTYIDNNGVEIKGTGKYVKESVIKNRTETKIIYQNMTTTTVNSNVDGRIGKYFEVSLQDADGNPIANKTVFIGFNGKVYNRTTNSTGGVSLQINLGYAGKYTFAIAFLGDDDYMGSFEVALITVNKQTPKITASSKAYRPNSKAKSLVATLKSAKGNAISGKKISFTINGKTYSTTTNAKGLATLNVSLSKKGTYSCTAKYAGDGMYKATSTKFSVKIA

SEQ ID NO: 152 - protein, 1024 aa, Methanobrevibacter ruminantium
MMKMTKKNLFLISLILLIILTIGAVSAADDLSASSDLTVEDSGEAIATAPEESVLINENNGDSIADKGLSDPISNETANIAIDEKTTNDKAISEEDNSIYSKDKANVLRENETPVILTINAPNIYYGETANVTVSARYGAGPLANSSINLALDGAAGENILIFDDGIAQKNYTGLAAGNHAVVASFSGYGPYPSASASKSFEVLTPTVNIEIEANDIYYGERAYVTLHVTYGNQPFANNTIQVSLDGQSSTSFIVEDDGNIQVTYSNLALGSHTVSAYFSGYGPYPSASASKDFKVSKKETAVSLSVSNPQLDKGDELRFTPSVISNGFYVMANSYSIMVDGMSNYSYWTENGTYFLSTSSLSSGNHTLTVSYAGDASFLPSSANATFTVNSYKATLSLMMIETELYPGDDCYIFIDLYDSNTHQSIAANITVSVGNNSYLYPIRVNSSFNLPTDNLAPGVYNVTAFFDGNGLYDPETAVGTLTVLSKKETTLSLSISNPVLSIGDELRFIPSLTGDGSYIWGASYTIKVDGMGNQTCRLVNDTYFLSTSDFAIGNHALTVSYAGNGEYMPSSATGYFEVTPKKANLSLNMLSTELYPGDDCYLYIYLTDSNTHQSIAANITISVGNNSYPYPIRENSSFNLPTDNLAPGVYNVTAFYPGNDLYGPETAVETLTVMEENATIKTETYLSIIMASGDKYLGDNIPFSVSRTPSGVSLFGDNYIFSIDGVESQDIFYENFSYFIVTENLSLGNHNLTAYYPGDEMYLPSSASQNFTLISRPKSDVLLSIEANDTFIGEDATIIINMIDELGNPIDGANVYLYMDNKEFALPLVNGVAQFSYSNLSLGTYLVSALFNGTEYYNPANASASFEVLNANLTVTKDNFFQFFNNNGVLNTNATDLKFVGEFNDLGITSIKINKPVSIVGENANIINIPVIVSSDDVSLANIAFAYNGSEPIIYANNVANLEIINNAFSYKSPSDKSYAVNITKSENVTIIDNSFNVVGGNNTYGINIDAIGFEIDSNDIY

SEQ ID NO: 153 - protein, 1024 aa, Methanobrevibacter ruminantium
MVIMNNKKLFIVSLIILTILTIGAVSAADDGLATSDEITVDDSSVAVSTASAESDIYETNGDIVADYQSDSISNVTVDDDNTKDEIIRSSPAKDNLLLDDDDDPGAVNDDDEGDDDEDYLDDISVSITNEYDVTDQDAVIVSIFVPDVEEGEDGIEGYFVVCLDDDDEIFLGPFNHTITPDDYGTDVTFTASDLEITEAANYWVRVFYVSDLAEPLIDNDEEDGYNMIFDGDCIARDYTQFYVIVPPDGRISIFDTSAIYTVYCPPGSEGTVTLTLRDEEDVETSFTQEIEDADDENQLYWDLDYMGLNTIDAAGNYEVTITLENGTLICEDDIRIMDPIEIPEVSYINSTDYDHATLVALIKIPSELDDDLEELIDGTVIIQIDDETVFEKTLSEFVEGESPDDPFWVYPKIHWSDELDTSVKLYYVLNNQLDIDLEPGTYDVTVKLDLDGWDEVSSTEEVRLVESNVVIDEDIGASIEIFDQEDILNDNEVRIIAITVTGDKSGRVNLAVEGCPEWECPLDELENEGDIYYINSGFDIESGEHEVVVSYVLNDDRSVSNSAILNFIVYPRIFICGNGGEDIVNYFADEDSAIHIYPKGDDVSTIRIVVTIGDEVVLDSTIDDLGLSPKINDWGETYYTVGPANFNKKLEFGHYEPVVAYYYSDAYELSTEDGELSFIDIIGMVHVADIEDDETPVLAVCSDRDGQIGVYIRQYTEDGDQELEPKYFEVEKHGFIMPTIDQLGLDEGQYHIDVAYADDEWIFGNDLIVVNSSEYFVLYGCDWLYTEESVVYVWCPDDAEGIISLTNNDGTINVDHEITDEDKGKYVEFTLEELGISGPGWYEISVRVNGNEIDHIGFDVPSPIYMPNYNVYLPEEGYEPDYSMIIAKLELNSELEGNITINLDGTIVFNKDIEDMEAIKDGSKWIYTIYTSDLDEAEEGMHDVTVTFNDLNEERSIEFLNRTTESDGNLSIIMLGGTYCINWNDVIAEVIAPTNYNGRLVLRLQGEIMQSWDELHWVNWDNYN

SEQ ID NO: 154 - protein, 1024 aa, Methanobrevibacter ruminantium
MKFNKNRGISAISIILILFLSISMASAIEISADDADMDSGDLSVCEVSTSDCYGETLISADASGADSSDEIIINETIADEKTDYRSSILADGEKKNLHVEVSNDVFTPDNDYEFMLYDEDFNQIGGYLDIYLNDELTYSDFTVDSSESSSISLSGLECGLNKITFIYDEDDVYNRLNQTKEFYIYGENPEFVMIPHYDTITLNGNYSSRVYLKEYDEWGYYDEDNEGDIEPIDDKFNVYIYKENPGDEYELVWEDEFEANGTINFDDAIKTTGNYLIRYVFNGSSDYSYAPYNSSNIIRCVNVITDFIINDTYFIPDKGFGFSVYLVDNATGDIIDKEFKLMVYYILDTSNPVRIVEEEMVKGNKTYTFDCSEIPENITYLFIGCIFDGDRDEYSSADKEYALELTDSRIETSINANIGDSVIGNSSSFRVYVQDEENWGQIDATLDIYLNEEYSQTVTAYAYLENEVLIENLKKGENTLRIVYNGTDIYQNSEKSYNFTVSDKRANIEVDVSNIIVGDVTKITVNLTDEDGNILNKEFNVSIYKGGSYYDEDSELIYSQVYTGSANISLPDLEIDDYYVRAEFVDESFVYSQAEDSEYFNVYSKGSYIDLGKTYWPDNDDVVLNISLRNYIEENINGEVLFQFNGTDYPLTCTEDGAILNLGKLPVGKYQIFAKFDGDGEYEASNLTDQLRIVKATIINVEACDVLKGQSETVNITFTDGDGNPLDVKMLDINIWDTDGNWLDYGQLRNSIEIKNIQTDYIIRAMLSDSYGEIGYSDYYPSSAYGFIRVLNGTDPTVITVTNTANIDLAIDGPKVIITLTDEDGKAISGAKLNAAVGNMESILTTDSKGQAVLAIGANDTAKVTYTDENGAGVSASIVNNVINTTVTEIVEKNITVPVTANATIDLAIDGSDVVVSLNDLDGNAIASASLDATVGTTNSTLTTDDKGQAKVAIGVNETAKVTYTDENGASVSASIVNNVINSTVVINNTVKRNATKIIYNNMSTVSVNSEVDGRIGEYFNVTL

SEQ ID NO: 155 - protein, 840 aa, Methanobrevibacter ruminantium
MAMVSASDISADDSVSLDAADSDIVSTDSISVDSVNTYSADSAISSNEDKDNYHPSNLKDDDNKISKINYELNDTVFYGDDVIINANLTDMDGNIIDEFFQVTVYDEGNPLQSNSLKGKGTMIVPTVSLTESSYYDVALSFAGNEEYASCNEFTSFNVTFKENSYLAISNYDSYSKINSTKINFIIYDVDDEYINDTADIYLNGEYYTSVLTNGNENEVTIENLQVGENTVLVKYNGSNIYKGSEDSATIMGYEKDTSIGIDAPDVLIGNDARIKINLTDEDGNIVNGRVDVEIYEYYTGDDESYVPFKDDYVVNGEAIIVIYQSKLRAGVTYFIRADYEGNLTYFRSVGSDYFDCFNRSTEIVIDGRIASDDKDITLEIGLFDQRQVMIAGLVNLTVFDNESNVVIDTISVETSADDYVNVTIGKLPYGHYMINASFEGNEEYEGCELEANLHVFKATNLTIEVRDQIKGESQIVNFSLVSSDGGLNESASLIIRNMENDLIYDGIINFTDGKASYNLDNLEEGLIILADYNNGMDLVGPFETVYDSASKFATVRIIKQLNGTIEFEPVNDSIIVNLKDIDGNPIAEAPLSVDVNGQVFELITDDNGQAMLDNIPNNVTIEVKYTDNQGLVASNKIVVLVKEQIKQRAASKIVCKNMSTVAVATPDGRVGEYFNVTLTDADGNPLVNKTVMIGFNGRVYTRTTNETGEVNLQINLGYKGSYTFAMCFLGDEDYNASYEVCVIKVSSHQPKLTGSAKTYKVSAKTKAISATFKTSNGNVISGKSLVFIIDGKLYNAKTNSKGVATVNVSISKKGTYSCTVRSSDDGMYAATSTKFNVKIV

SEQ ID NO: 156 - protein, 279 aa, Methanobrevibacter ruminantium
MFILKFEIKRSLIFISILAILILSIGMASASEEISDSVSTDIASEDVTSEIQTDNVEITNLDEDSSLDDADLEKDTGDKVKKAKKRINTKIIYQNMSTTAVVNEYDGRTGEYFNVTLVDEDDKPVVGELIQIGFNGRIYNRTTDSNGGAQLQINLAYSGPYTFAICYLGEDTYESSFEVAVINVAAKKMTLTVPSKSYKASAKTKTLTATLKDNKGNLIKSKQISFTVNGKTYSAKTDSKGVATVKVSLSTKKTYSFTAKFAGDKSFGAVTKTGKVTIK

SEQ ID NO: 157 - protein, 1024 aa, Methanobrevibacter ruminantium
MQAIIPVKDNFLILVTNMKKSDFKRIFICLVLLTCLIGAVSAAEDVSVDDVSTDAVAVDTITEDASDPTDISTVSEPVSNDVQANTSQELNKEPATKSTNVLKDGTSTNIYVATTGSDENDGLTQSTAVASLAKAVEIVNATAGTDFTINVANGDYNISKIESPAAKNVNLIGESKEGAILHASDTYGINVYEDNIAWTIENLTICDFNSTTSTSAAVRCFAIDSVFNINNCIFKNIGSKNGAIYITSTGTRTISNVLIEDCFGTYSSSSSIIHLYGEGPVTLDNIEIRGSYMDPSVGTATYLRSVIYADQAQTNVTLKNSRIVDNIGAMGSLIEAKGAFKVINTTFEGNYLNTSSNGVNGGTFMFYSGTSSNSASNIDISQSVIKDNVLAGGSIGLFNCVYGTHNIDHNVIMNNKYANGNDVPLGSFSGAAISTDDNYWGTNERPNTKTTEWVILTVDTPEMAFVGVSEAIPVNLNTYKTTNNETGAVEGMPDVDFGVTYALNQANPSTVTVANGQGTINYLATVDGNETLTFSTGDAFSFDVKADIASLIYVDGLNGNATGPGDSEHPYKTIAQAINVAADGKIIVIKSGTYTENSLIIANNITLKADKNAEVIIDANNEGRIFTVQKDAIIRDLTLINGKSTGNGGAISLDSGLLTLNNVKIYNSTAQSGGAIVSLSGSQLSVSNSEFIDNNASNGGAIYVAGVADITNNKFISNDPEDGGAIYVAGVADIESNEFTSNHATNGGAIYIDSENNQTIKDNTFTSNTADKGEAIYIKNANVSLSGNTMGENDSIYLDGASLKTTLTFLGGKTIAAEFGQTLNLTATLTDEDGNNIRGGIVTFTANGETIATIDLSTDAQLKTQYTVPNDAAGDITISGSYSLDNGGAVISGKIHPAVPHWFIEGGSGYETLADAIDGASAGDIIYYDLPEDYTEVISSKTINKALTIKNNGTGVVTLDGNLDRILSISSASVNLENLIFINGATATNGGLIYLSGSASNDLNISGCTFKDSKFTTTSTYTYA

SEQ ID NO: 158 - protein, 1024 aa, Methanobrevibacter ruminantium
MNFKKLLMISLILLFVLSVGFSTASAIDSDNLLDENNNINVNYIDSDNSDSILISDNSNDAKSNNLILNNSINKKELNDNSNSNSNLECDSSINENLDLENNYKINEKSAGLKDNTNTIYVSVDGNDENDGLTLETAVANISKAVSLAGEGYTIHISSGTYEQNKSTQLSHAFNFIGEDGTIIKRIGTANAFTYTSDTKKTISFKNIIFSSTTPNPSNPILSMAGGADLQIDNCTFTDAIAGRNGLIRYLGSSTGKITNTNFIGLTGSTSASSSYITALAQSKVKVENCTFANINEPGFLNSLVYVNNNETNLTLVNCVFNNITGNLNAVVNNRGYMQIKNCSFTDISLSGNSPRGIVWSSETISKNSITYINSSVFINNSVNTEVVVNSSVIQAKSPTIVEYSAFLDNDVVFIINNDNDTDVTANYNWWGTNEGPKNCSVNRESSASSNPSSSSEEKISLVSDGVTVDNWAIMTVDLETSGLIAGEDYPIIININKYMNERGEIDSSVEYGISGAEILLSSQIGTFNSDFIIYNEDNGNIIQNQAKVYTNNGAVTVFYKATEEGSDTLNISSGYEEIVYNLEFGQSIEYNDIYVSKDGNDNNDGLSNETSVLTIARALEIGENLNSNIRIHIGSGSYHESGFELNGTYTVQDGVLQVKRTTYSFIGYGNVVIDGDGQNKSLFTVRNNSVSYKNIRFTNVDGATYGGAINGDNLYRRTAYIDLTINNCTFDDLHVKSSGGAIYLNYVSGRISINNTKFYNLTTNSSWGGAISAEEAFDLARVKVTNSDFRDNYANNAPAMYLRVSNVTVLNSNFINNSAKYYPGAIHFYNASAIIENCVIANNSAKKDSAAIKISEGTNDVGNKIIIKSCIIENNSARDEISPAIYVEKGALDISYSSVVNDLSIATRTYYSNLYGLQQGVAIANNNWWGLSNPFGENEIGGNYSSLLGGVFNGSNITVDSWVILNAVLNDTGVLKVGNIVNISIDFNHVNTTRGEIELLSGGKIPKEYTLRLNATGGIVYPNY

SEQ ID NO: 159 - protein, 1024 aa, Methanobrevibacter ruminantium
MFLIGAASAADDAVTLEGDAAAVDSISEDASAPITTTVSEDASIGTTFSDSAIESDSIQSNDDLELKNVTDVKQKDSSDALKDGESTTIFVSTGGNDNNDGLSLETAVATVEKAINITKTGGTDFTLLISNGDYNIEQITIPVGKYISIIGESKEGTILHASGDYGFDISYGCNFENLTISDLNSTSSTSAAIRIIMDNYDININNCIFKNIGSAYGAVHVYSNGKTSISNVLIEDCFATKSDDSSIIHVSGKGPVSLDNVEIRGSYMLPPAFPWSTPYLGAIIFLSSADPDVTLMNSRIHDNNGSIYSIITSKGKIKIINTTISDNCLNASYASIFSSGVNSNTATDITVTQSVIADNILANNAVGLLDARFGVFKVDHNIIINNKNANGNDLSVGDLSGASSFSIDDNYWGTNVRPNDKTSEWVILTGDVAECAFVGVCENIKIFLNSYVTESGEIGVIDGMPTVELAVGYALNQENPSAVTIKDGVGTISYLASIAGEETLILSTGDVFEFNVSSEIGSLIFVDGSVETSGDGTQENPVKTIAEALNIAADGKIILIKNGTYKESNLLVDKDITIKPYDGADVIIDGDNQDRIFTVTSTATISDLSLTGGNATGDGGAIYLNGGNLTLSFLNISNCIASDNGGAIATAAGSDLYLSNSIFTDNFASKGQSIFIGGEAEILMNDFVAHMDVLSPDASFNAISINTDSPVSIVSNNFNDNGAIKGQAVYIKDAPVSLSGNIMDDEIIYLESGSVNSNLIFMDGKTLTVEPGADVNLTATLTDDKGNLIRGGELTFTANGVAVGDPIDISGDNELRIPYTLPSDSEGDIIISGSYSFDNGGTIVNGTIEPDIPYWFIEGGRGYKTLNETVENAVAGDVIYGSPGTYIANGIFITKDLTIKANETGDIILDGNGSRVFTIKNQATLSLVNLDLSNGGSEGGGFVYIYAEGGNLNVINSTLRDLNIVGYPESFEGGAIKTYASSTINIESSHFENINSSAFAPILSGLGGVKLSLTIKDSSFTDIK

SEQ ID NO: 160 - protein, 687 aa, Methanobrevibacter ruminantium
MKIKKSFVILCLIICLFTIASVAASDINDTTISDGDNLIKEADGDLLSLEDDNNLKELNEESDKNLLVQESDNDNNNPESDKDLLVQESDNDNNNLESDEGLLVQESDDDLNKKADGSLFSSKYGDNAAPIKINTSYLIKEINSYLEKDNYTALKEEINNYLKKSNNNAIKEEISKYILKNSYKALQKEINNYLEENNFSTLIKEINNYLEENNYPSIEDGIKSYLQSNNYSSLQDVLSDVISKIINSSKKESEPIDDGTFTALQYKINSAPNGATISLDKDYSYDEGFSTRGIEIKKSITINGNGHTINGLSASRIFLIHFGLTGNNKVTLNNIVFANGKTDLYGGAIFNYGNLTVNKCTFKNNYAKTCGGAINSVGEMILKNSNFKNNTAGGDAGAVFSFKIGNSTNIFKDIYKDKVIDGNMDFIIDYILNININYGWDSINNCSFSSNVAKGRGGGAIYAFTHIKINGCTFNSNKAGEHGGAVFANKNLNISKSKFTNNKAPKYGGAVYFRCHELSGSYVNKTWVSKMKYYTATIKDSIFTKNTASKGGAIYEFNHTVSDKKRLKVSKCNFTDNKASLGRDVFSGSCSNCIYFYVKISTKSVTVKKTAKSFTLTATITNGTKKLKNKKVTFKFNGKTYTTKTNSNGVAKVKIGKAVIKKLKKGKTYSVQITYLKKSAKTTVKVK

SEQ ID NO: 161 - protein, 67 aa, Methanobrevibacter ruminantium
MTVSVFISASFAFGNVLSNADNGSVQTYNSHKDISSPNMDYKHPGELIYGGCGGNQNIQTDGHICEK

SEQ ID NO: 162 - protein, 1024 aa, Methanobrevibacter ruminantium
MKVLKIAIIMLILIISLGAVSATENFNNDLSDNGLNDNTLSDNSLNENTLSDNTLSDKSLSESTIIQNDHDNLKDTNNNDNNKALKDPAKTFTDLQMEIINASDLLELTDDYKYNNETDNITLTISKSNFVINGNGHTIDGDNQCGIFQINGTNITLKNLNIINANSTKDSALLLNPGSELETNNVTFINDSSDKRVIFAFGAKYTSNNDKFIDCTSLNDGVINSYLGEITINNGYFESSKPLDWAFVNSLGNSSIYVLNTTFANTTSKYATAIKGDRETVIHDSKFINLYANLTAGAIGLKRIEEAEIDNCTFINVSSQKNGGAIFLDIYSDSEDVPIMISRSSFVNCYSEFGGAILSLGGKITLEEDNFTNNGAFFDGGAIYSSFSQLTISQTIFDNNSVELDDDRGSFGGAIFSDISALIILNCSFSNNNAQTGGALYTYDSGYYIANSTFKDNTNKESEFDDIFTDFDGEIATLENNSYSGEDSICLNNERYESVIAVSGMNFTLIENEINVTNPPRKFDLREWGWVTPVKNQGYMGSCWAFGTVGAIESSILRFLGLEMDISENNMQDSLLQYYRYGTLGAEEGGEYNLGPSYALSWFGVFPSEYDVYDELGKISAIIATDDSIHLQDAVFVPPLMNSTDKDKLKQSLLKYGALAVSYYAETDEPGLNENTSSQYSLKNDSNHRVLLVGWDDDYSKDNFYMTPPGDGAWIIKNSWGEELGDKGYYYISYYDASFATLVPSVGFPIMNTVIYNKNYQYDIGGTLEFTDMGNEYVNEFEALEDDFIAAVGTYFIDAGVDYNIEIYVNDELKYSQDGTSPFFGFHTIQLDSYVPIKEGDEFDVKITSDCIPILESGRQHYIENKSAANLNGEWVDLTSDGKVCAIKVYTTDEDKKKESSRINTRIDCKNMTTTAVASEDGRIGEYFQVTLKDENGTALANKPIKIGFNGRVYDRTTDENGSAKLQINLAYKGTYTFAIGFLGDEEYLGAFEVAKITVKVQTPKLTAPNKSYKVSAKTKSLTA

SEQ ID NO: 163 - protein, 1024 aa, Methanobrevibacter ruminantium
MNFKTKGSLILISLLFILIIGIGMASASEDINTDIDTDYQSDSIDVSDVSLNDEQIASEDSLPNYEIANKSKDKLYDEGEEEEGGITNDDDDENYRIDGIYADYTITPSENGTIFVEGERIQIIFNFTDQDYEPVSGDWFINFYGESTDVDIYHPFEATGLTDYVVPIYLPPGDYVIFFYEGVVFDDFGGIEDEGTQLDVTFEDAEGNQLDNPEFSIRTNYNKKVYANLTIDYSVAELENLVEGDDITAKISLMDEFNNKMTEKVNLEIYRNGENYDSKKVNVVEGQNNNIIFENLQEGNYSLEVASIDSVPKYTNIITKAVNFTVKSNYDPDNYQIILNPEDEKKLVGDSYEMGVKLLNPSEEAEEGSIDLYLNGNFVKTLELNYDEDGYSHHIVEGLQLGPNNATFLYQIRDGVNVSESVNLIRYETESIIDLESSDIIIGDDAKIKASLSYLDGIVKKPINENFKLYIKNYVEDEDEVEFVYDEEFTIKGSETITLSDLEEGTYYISAVYNGKNYKYLATEEESTLEVFPKETRVDAVARTYSTEENVIVGIELADLSGKAIKGTVNVVLDNKTSYQVNTTDDIQHPVELDLGKLGYGLHNIELNYTGDDSEGWLPSYNNAEFLVIYPSFMSIEDGDVTSGSDLTVNISLTGPDDEGINGIITVRIYDNTGKYLINGDFNTTNGVKSIELKNITKDYIIYGRYYGLDTSKIEIGPSNHYLSSEAYGFIRIAEGKSEKTEYDLELTKVNDNTVIASLKDSDSKPVANAELTVKVNGVESKAKTDNNGMANISFSGNSSIKVSYTDANNTTAKASMEIIIINNVTEKIVNQTVEVPVEIEKIVYVNQTVEVPVEVEKIVYVIPNRTDTAFEYENMVTTAVASADGRTGEYFNVRLIDATGKPLAYKPIKIGFNGVVYDRTTDADGRAKLQINLGYKGDYTFAIGFLGDDNYTGAFEVAKITVKLQKPQLSTASKTYKASAKTKTLTATFKSEHGNTVSGKKISFTVNGKTYSGTTNSKGIASV

SEQ ID NO: 164 - protein, 206 aa, Methanobrevibacter ruminantium
MGKFKFIFILVLALFLICGIAAVVDAPDSFDGSLNLIPVSDSSVSQSDSSVNQSDCENGTCSVDLNKSEDNSSKETSDDEIDYDSKYYDDSLIDGLYFCNDLEHAFKDAKQHHKNVMIIFDGAACIYCEYLKDEGLTDSDIQKEINENDILLMTYTSDSPELSQKLEIYGTPTTVIFDENGTELGRIEGYESPEQFLSELKEYNGK

SEQ ID NO: 165 - protein, 274 aa, Methanobrevibacter ruminantium
MDSKKILMIAVVALIAIVAVSSCSAGFLDFLGGDNATDDSLNGKEVNLAAAASLKNVYDDELIPMFEAKYPGVKVTPTYASSGDLQTQIENGLETDVFMSASNKQMNALADEGLIDNDTNLQFLENKVVLIVPKDSDLNITSFDDLKDVKGTIAIGDPESVPAGQYAKEALTNLGIWDAVESKFSLGTDVTAVLNQVAQGSAECGIVYATDAKSNDDVKVVCEAPENSLNTSVIYPVAMIKDAKDADAAKAFLEFLQTQEAKDKFVEYGFTIHE

SEQ ID NO: 166 - protein, 1024 aa, Methanobrevibacter ruminantium
MKLKSKYFVFLLIICILFSISTVSANDNDMSINQNLQNDANQDINQDLQLNEAYQSDTNLNQNLQANNQENDLLKASEDKTYNDLYNDIKNCEDTFNIENDYKYTESDNHTFISINKTNLVINGNNHVIDGSNKAGGFEFLKESLNIIINDLTFINCNDYTIVNEDGGNISLNNVNFTNNHNKLGILYSEGMISVFNGALTINNCNFDSNNNTNLIYTNFAELRITNSNFSNGKGIGSPIYANRFELYIDNCSFENFTAPYGGAINFKGNTFVIKNSKFKNLNAEITAGAIFAKYFPKTNKDGPYIPGEDMLFENCEFSNVSSTHNGGAIYLNLDSSSEGFAKTIHINNCNITDASSDFGGAIASQGEILDFSNLNIINCHAKIGGAIYSSWADLSLKDCNIINNSADKDAGAIYFDYSKLIIDNSNFTDNKVNNISSGKESIIYANDVDAEIRNSIFDNGGVAVYANFASNSKFENNTSTDLFLWNNTNYIVSVENKGIKLNLTNNTINVDKLPSKFDGRDWGWASPLKFQGDNVACWAFATAGALECALLKQTGVLYNISENNIQNLQLKYFSEGDRRNSAIGYAYSGLGHSLSWYGAITSEDDPYDERGMYSDVAETDKRIHVQDAMIIFGGRNDTRNLMKEAIMKYGAVSIQYMYAPYDYTANYTEVDLQPGHFVTLIGWDDNCPPEKVNTKMAIDETNIPPGPGAWLMKDSEDSKLGEDGYVYLSYYDLSILSKDFYPVIPQAAGVAYIFENTNDYHVNYQTDITGLAGFDENYSYYSNEFVSKYDEWIGAVGTYFNESGIDYSFDIYVNGEKAHSQNGTSEFAGFRTIVLDKYVPIKANDTFKVIFKSNALPFQAYSRQHYIPNMSMISADGSNWIDYADKNRTVCLKVYTIESDKENISSRASTIIDCKNMTTTAVASADGRVGEYFVVTLKDQNGTALTNKPIKIGFNGRVYDRVTDENGSAKLQINLAYKGTYTFAIGFLGDEDYLGAFEVAKITVNLHSPKLSAPNKSYKASAK

SEQ ID NO: 167 - protein, 41 aa, Methanobrevibacter ruminantium
MNYSIIIFIIFLMDALVLMASIQVCGACGKGSNPLCVPMVM

SEQ ID NO: 168 - protein, 265 aa, Methanobrevibacter ruminantium
MKFNSRVLGILSLLFVLTILVSSVGAAEYKLTEKDFNNTFKIGIPEGTDFQQDAYSNIAAGNVNFAMKVFDNIGNNTDGVVSVLYFKDSSSDSNLISDVIDDLNSSGEVVEENDNYIIVKNNYDAEWNAPDASTSSDEFWSFIGDLCSSGSDMNFGDGDSNIHLSDDGVNIEDSSANVSFSKNGIYVSDSDGQNVSISSEGVKVSGGSSNETVDVNADVDSVMNSYSEFADYSLCLKNPKKDQLIIICGNDLDLLKQMADSASFK

SEQ ID NO: 169 - protein, 787 aa, Methanobrevibacter ruminantium
MSNIETDDSFISENSISSDINDNSLINEFTASNQINDNIAINDGLSKGDKSQLSESKSIYVSTNGSDDSGDGSEKSPYQSIKHAVSKADDDSIIYLSSGTYNGENNQNISIGKSLSIYGEDSTIIDGEDKAQLFIMNSSAKLSLNGLILTNAYKDGNLSDYGGAIINEGGQLTIINSTIKNSYGNYYGGAIYNNLGRLTIINSSILNNSAIQYGGAIYTLGVTNIQNSVFEKNTLTAEKGVGASIAAGGTITLNNTDFLNNHAIYSAAALLSLGNATINNCSFINQTTNYTAGAISNHGNMFINNSLFFNCRVRFYAGAILAPPSGHHVVTEVYNTIFDYNNAGNHGAVTNNFQDAEITMINCAITNNYIQKNVFYGDIALDDNATVQYCWWGQNNISSYYYSPHSNNEDPGQINASRWLMMTFTSSNGNISADEVNTLTVSIKQYFDNDTKEIYEYNEDINLPLTVKFFDDNKKTIATKTLKNGTASYNYIPVKGVNAVYAQITNEIIEIPVVQKKESNLSTSNLTKYYKNESQLEAKLTDGDNNPLSNKTISIELLGKTYNKTTNENGIVKQNIGLKPGQYTANIIFKDPEYKNKNITVQITVLKNSTSISAKNLVKYYKNSSQLTVKLLDNNKKAMKSKKVKFTIGKNTYTRTTNANGAATFNINLKVGTYNVKVSFGGDDYYKGSSKTVKVTVKTTKMQAKSTKIRKNSNFVATFKDANGKVIKNTKVKFTLNKKTYTKTTNSKGQATLKVSVKLGSYTIKSQYASTKTYGATVFNTKIKVVK

SEQ ID NO: 170 - protein, 368 aa, Methanobrevibacter ruminantium
MEKKTTIILVILIALIACGVGITLFASPSSISTDGNTTITDMANRTVNISSSVDRVVATSPPMTTIVYMLAPEKLVGVNFQWTDEELKYVPDQYKDKFPVIGGWFGSQDGNYEEFIASEPNLVIEGIDEGMGVDLSTVEERQEKFGSLPVVAVTDNTNVTKIDNTIEFLGKLLGAEDKANELIAFNDKYLSQVQSTASSIPDSEKKSVYYASGEDGLSTYASGASHGQLISLVGGKNVADTEVKDSGSELTVSIEQVMSWNPDVIIATDEDFYNKVYNDSKWASVKAVKDHRVYLSPQSPFKWFDRPPGANIIIGVPWTAKVIYPDKYSNIDMVGATKEFYSNFYHYGLSDEQAKEILTSSGLKGSDL

SEQ ID NO: 171 - protein, 1024 aa, Methanobrevibacter ruminantium
MKNKSLILISLLLLITIISIGSVVATDNEEINMDNINNIDNNEDIANIDNVDNVDNSNINNPTDIRIDNSNLNRETELDSNLNKSNQIREDELEQSNAKSNLKSSKLSSTITVDGSDENQMSNPTIQSAIDSANAGDTIIITGKSYVHCHFIVNKPLTIISEIGTSMSPCPSNTKGSGAHGIFYISPEASGTVLKGFNLTNTYGDYDDYGILIRGAENVEIINCTINTVSDGDGIRIENATNTKIADCLIKDSNIGINITGSSKTTVTNNNITNNKVTGVNVGINNNDTTIHTNNITYNQHSGIDLYSGDYVYILNNFIGHNQNSKSSSGAGIYVNSNITKVEIKGNFLKQNGQYGVLNDYRVRNMDASRGAETLEINNNNYYLGHTERITYHIEYSKYAGGPFTYDSENDLYVYVGDGNGDWDIGKTVVYLGYAFYRDETVCGSTLFKAPSTTWGTEVYKLEISPISQVKKGVYSVSIVDVNGIVASDISSIYVTFYLNKNNTDAEPQSGDIYKTVLMENGTATVNLTDKEFKESGNKITACFPGLYNVYTINPYATFDVNDSDIPGSYRNTTINATDMSLVPNSGNKITARLTDENGNPVAGESLQFKISGISTTYTRTTDENGEANLKVSLSNPKTYTVNINFKGSENYNKSSKTIKLTVKKQTPKIESSNIDLLPKSGENFTVTLKDANNKAIANKEISFTLGKKTYTRTTDENGQASLKINLANTGKYTITTKSEKTSQYNEVSKSNTITIKTGANKVNIESSDKTYIPKSGENFTVTLKDANSNPIASKEISFTLGKKTYTRTTNENGQASLKINLANTKKYPITTKYAGDDTYSSASAENTITIAKAAAELTTYNRTYINKSGQMFSAKLTDKNNIPLENEKISFTIGKKTYNRTTDADGLAYLTINLAYDKNISTKFLGNDQYNAKTNTNSITITDEIETAYIDKGLKNDEIQRIIDEIKPNYDVKFLGDSYDDVNLNINKTLLIYTDVNTTLNGKSASPVFNLRGGNIGVSFFNI

SEQ ID NO: 172 - protein, 34 aa, Methanobrevibacter ruminantium
MRSTILLSASTAESRSPSLTTGRCTVQTVADGMP

SEQ ID NO: 173 - protein, 128 aa, Methanobrevibacter ruminantium
MLLICFIGLVEAILMALVDWEDLAISVRKSPRKLYNVLKDELGLPEWNELSVIERRSMKKRYAVIRDSFPELPPWEELSVIDRRSHKRLYKLIKSVYDGDYDDSPSLEGPPAAVGPQKEIPLEEAEYP

SEQ ID NO: 174 - protein, 686 aa, Methanobrevibacter ruminantium
MNKKIILSLLLVLLVAISVSAVAAADADVTYINDAADVDDVADEKVAPLTASADAQDIQTKLDNAKPGDTIELENKTYDVDTTFNVTKQVTIKGQDTVIKASGASQGGSGALFIANEAGTAFEGITFINTDGHKNYGEQVSGYAIQLAIENGTVDNCKFIDWSSGVYGKGASFCSITNSYFNGSSEQVTNGGKKEYGTKAINLMGSHDITVTGCTFEGQVLDAISIASNSGNNIMTDNTFIDNCYAIYFGGASTQGCVIANNSFIRCGYCVDDKGNVIFKDLPIISTQKAANGYIIADNTIEANEGSIFMKAESGNTAHGYPSKIGDINITGNTITATAGANPEGITFMYILSNSGPLNPYAPIAIVNNNLDAGITPVTVWYADWDNENGTVIPAADKAVTSINIAEIAAADGTVTVELVDVNGAPQAGQTLSYKIDDGNATEIETDENGKAVINVPIDENATAQTVAVEFAGTNDLAASSAQVSFKNTATKRTATQINANNMSVVTLAPNTGDTNDNYFNATLLDAEGNPLVNKEVKIGFNGKEYTKTTNENGVAQLKINLGYKGGYTFAVAFLGDDEYEASFGVYLINVAAQTPKLTTKAATYKASAKTKSISATFKTEQGSVIANKKISFTVNGKTYTGTTNSKGVATVKVSINKKGTYSFTAKYAGDNTYKAVSASAKLTIK

SEQ ID NO: 175 - protein, 696 aa, Methanobrevibacter ruminantium
MSLSIFVLVIGGGFINKRILLIFVFLIFFISIGSVVANDLDSNSVNQDNYISDVDSFDGSNSVLSSSNLDSSIDKDNYLNLDSNNNLNLDSDKNSVSGSDLNLNNADLINSVSGSDLNLNNADLINNSTTNDSSNSNNSNNLENLTNLDDSKGASNQKPQKYLIPNDSSIGSAYIQKIIDNAAPGSTIQFTGSFYKNIYLKIDKALNIISKSGTVINSSYRLPVFTISRGGSGTNISGFTANLANSFVEASDVSDISISKNKIFTKRKAIVLENVFNSKIVRNSFLRFETAIDISKSGGLTISNNNITPDNGYNVGISLKDIYRDKVSILNNNITGHDRRIESTGIYFGPNAKNVLIEGNIIDEWYTGVDFPNSVNNVSILNNTLNHNGDGVIINGWINNFTFNKNVVTNTGRVGVLFDYDFYGTKGDFTLEKNFFTQSGQLDLRNTGDQAVTIGENFASRRCVRVAMKNGFSIKTRQNGNGYYFSIVDKNSRGVSGLPNFSATISINGVSYNVNFINSVAYVEVDGASGENDEVLLDVGEDKRKLSDWGETQNLSSSEMEYYKKIYDDLIKSMVEETNNDNQDMKKVEDKNGTGSTPSGGNGGGDSGISDGRSSVSSNGDSSPASAGTSNVAASSASSSAGPSAAQADTPESSTVKSLSLDEETFRVAGVGGLVFLIICVIGLYYREDIMDMIKE

SEQ ID NO: 176 - protein, 540 aa, Methanobrevibacter ruminantium
MNNKKIIMSFLLVLLIAISVSAVSAADIIADNQDSISSNDNSINEIATEDISKDINDKSLSDGVSTGGNNWIVKPSTDGKSDANSIQKAINLDNTKPGDSLLLTDKNFTLEKSVSLNKDLTINGGNIYNQNNLTDLFIIDPKSEGGPKNITITNVTFYVNGNENIVLANGENYGTTYIDLANIKISNCTILPINPDSNINDTVLLNIKSDRTVGQTGQSTGFVLVSGNKLNGINTLKNNDYVLKDDFVIQKADPILNTALICPNMTITTYDKNTNDTPSYYEVKLIDQNVNPVINRTIQIGFNGKIYDRTSDENGIAKVKLTLAYTSVYTFAVYFLGDESYASAFDVSTVTIIKKNATITPKTVSYNVNAKTKTLTATLKDKNNKALANKKVTFTVNGKTYTATTNSKGVASAKISLSKKGTYTFTAQVLQGTISIIQFPKKGKLTLNPLSTNLTVKKYTFKKAATKKIQVTLKSGKTVLKSKKLTIKVNGKTYSGKTNTKGIATITIKLTKKGTYTYTANFAGDNTYKAISKSQKVVIK

SEQ ID NO: 177 - protein, 1024 aa, Methanobrevibacter ruminantium
MNNSADNGAIYFNNQNFGQNLTINHNIFLNNDAVAIYFVRNDSASNADYNWFGNNATNCDIAPTSNNMEMNTWLFLNATSEPEGISILDSCDIIFKLYAYAPSGVSEYDSSRLKEINLTVTPTNGRINTTQAKLGEKVHYTPESAECMLTASIENAFYTTRLKISDGTTFRDLNNLINRNDNDTIILDNDFIYNSLFDSKFKNGININRPLTIVGNNYTIDATGMARIFRIQADDVEINNITFANAKIDGNGGAIYWYSGARGIVSDCSFVNNSAKMYGAAIYWNGANGNVSDCSFVNSTVTDEHGGAIYWHGANGVVSDCSFVNNSAKKYGGAIFWNAANGVVSDCIFVNNSAKSYDGGAIVWNEGLNGAISDCSFVNNSANDGGAILWNEAAGGTVSNCSFVNNSANKSGAAIYWDSGARGVVSDCSFVNNSANRSGALYWFANDGVVSASIFVNNSGDNGVLYFNNTNKRNLSINDNIFLNNDVVAIYFVNSDSTSNADYNWFGNNASNFDTEPLTTNVEISTWLFLNATADPNPVEILNSSDISFKLYSYNATGISDYDNSQLQPVNLTLTATKGDVDSIAKLGETVIYNPTSLGTGSVTAKVENVAYSIEINNIKSNPNLSVESDELTYGNNIAIALNYESAATGKVNITLKGKKSDYTFADLDLNETISLGILAADEYEVIVEYSRDEIYTNASARGTLKVNKANSTLTVSDIEFDYKDMGSGEISFTNATGVEAKVINHDEAIVFVRGNTITVLNLSADSYILEVTTITDENHNEVSKNATITVRKVNSTINVNDIVLYYGESINLAVTTDGAIGISADIDGENVELNENIVTIPDDLESGNHTLTITTVPNDNHKEASKTVNIVDCRIGNITVVVDGVEYSIPAVNGTAITTNMPEEIEKLKENITDLTGQLEEAQTNATNLANNLTIANQIVDKLIAQLEEAQANATQTINDLTHQLNEAQTNATKIANDQTNANQIVDNLTGQLNDAQTNATKIANDLENANQIVDDLTRQLEE

SEQ ID NO: 178 - protein, 843 aa, Methanobrevibacter ruminantium
MAGSTIRAFKVTASGVTIKNLTIKNANVTTDDLGNTDDEGAAIDFEKSGTIEYCNFINNSANAAGAVYFYKDNSKAINCNFSYNQAVYSGGAVCFEESGTIENCTFVNNTAVYDILGGGGAVCFNGTGNAINCNFTNNTAQGYFSWAGAICFNTNGNAINCTFTNNKAHDSGGAIEIYGNGKLENCSFDKNSANDGGAVKIYGATKISNCNFTENKAAELSGDGGAIYWNASAGKLENCSFAKNSAFHGGAVSFEEDGEVTNCNFTDNLAGDSGAIWFTADGTVENSTFIKNEAWDEYGGGIVFYTSGDVRNCNFTDNEADKQGGAVYFNGAGTVENSNFTNNKAQDGGAIFFSEDSTVKNCIFVKNCATDIRSDRYFERCKYVFYKNGEVTNSSFTENNATEGGAILFKGNGKATDCNFTNNSAKFGGAIDFESHATVENSSFNGNKASSNGSAIWMNRAGGIVSSSVFVNNRANTGTIFFRNDNSTSHLTINDNIFLNNNGVAIYFDKNDSDSNTDYNWFGNNATNYDIAPVANNAEINTWLFLNTTVNPDMISILDSLDIAFKLYAYTPSEVSEYDNIRLKAVDLTLTPTNGIFNTTKTELGKTVQYIPESDGIGTLTASIENASYTTTLKITDGTTFFDLDYIINANNNNTIVLDRDYTYNSTFDYNFTDGIVIDRPVTIIGNGHTINAAEMVRIFHIQADNVKIKNITFTNAISNGYGGAIYWQGANANLSSCLFENNSAVMAGAVAFYGSTGSIVSDCSFMNNSANNGGAIMWQVSDDSVVSDCSFMNNSAIQGGAIYWSSNDGVVSDCSFVNNSAVRNGGAIYWEKIMVMFPAVFL

SEQ ID NO: 179 - protein, 75 aa, Methanobrevibacter ruminantium
MKIQRGIYIILTLLVLFSLSAASAADDLTDDIISADENEELILDETVIDDVSNANDNYDEELIKANDEKFVYAWK

SEQ ID NO: 180 - protein, 76 aa, Methanobrevibacter ruminantium; identical to SEQ ID NO: 36

SEQ ID NO: 181 - protein, 237 aa, Methanobrevibacter ruminantium
MNRRSKLIIAILIVIIIGIAVILFGSMFGGEKLSSGDKDILVCAIDESEPRPGMGAVDMAFLVHMNDGGITNYTPIYPHGMVHPSIAEPEEYQAMGAGEKLLLHDCFYWEDKQQCMQYAKEILEYNTNYSCDAVIAVNSQAIDNIISAAGTLKYNGEEVNASGIDFIREEQNTMGMTRGDSVMVIVNALMQAAKDPDKRDKMINAAVSEYTAGNIAMYPEGSFMELLASKGLQAMFG

SEQ ID NO: 182 - protein, 238 aa, Methanobrevibacter ruminantium
MKRSKKLIIAILVVILLGLLLAIAGYFVGGPDLSQENKTILVLAADKYEQPNGGCDMAYLVRLENGSLANYTPVYPGGMYHPSQSAPGNLQGNMLLHDCLWNGVEDGMQYAKEIVAFHTGVEADAVVVLYDEGVDNVLDSIRPIEIDGEPTNLSATDIIRENDNYAGYKGNEGVTGTMSRADAVMVLVKAVSKQAKDPAKKSAMLHAALDEYTKGNIVMTPKGSFTRLLATKGLESFA

SEQ ID NO: 183 - protein, 442 aa, Methanobrevibacter ruminantium
MKEYKIAIIGGGPAGMIAAIRAAEILGPNAVCILEKNESLGKKLLLTGGGRCNITNNTPIHDQLNYYNKNKNFLKHSLYTLPQDKLLAIFEEKDLEFHQEDNKRVFPDSEDAHDILDILEEYLEELGVDVYNNTPINAQDIEHELNERMEPVFEIENEKISLNASKIIVSTGGITYPNTGSDGDGYKIASHMNHTITDIKPGLVSFNIDDFLLKTLSGLTLENVEVSFKDKKKKISVKGDILISHFGLTGPAIIDLSNRLLEKSDLTVLDDKLNLKSRDEIEELELFTNRITIDFTPDLTEEDIKNQITKDSPKNGKMAIKNYMKKYLPNNFIDYFLMKIDINPKKTMANITKKDKNKLAENLKRHVFEIESLEMDLAKVTIGGVKSKEIDAKTLESKYVEGLYFAGEVLEVAGPTGGYNLQIAFSTGYLAGQEAANSLKNE

SEQ ID NO: 184 - protein, 101 aa, Methanobrevibacter ruminantium
MANEGGGHLKTILMIIILIAFICGLALGVSVIMGGDDNSQTESEGVHYVNVTKNITEYNESGNLIETEDGTHIEFSSYSDNVTEGENVTAYNSSTDAGNLF

SEQ ID NO: 185 - protein, 129 aa, Methanobrevibacter ruminantium
MDNKIKAGIALAIIVLVAVIGFSFINESNNVVNQLSPLTESFDYSMEPMTTWDDSKKEYSFNQNISSANGKDYKDITIDILMYNDGKSLDKHTSTINSTKDGSFNLKFTQRLEGEPDEFYYNVTKATEI

SEQ ID NO: 186 - protein, 342 aa, Methanobrevibacter ruminantium
MFKVSKSILIVCLVSLFLLVSQASAADSNGLSIRDINSVDENYNLDASYLDSLQDSNGMHSDSSLNSNGLDDKSNYDKTSISQNQTSSNLKDNDLDNNDGESEIIEEEAKDTEGVVMAGDSYSCGPASLATALNRLGLNLSLSEVSQHTNTSKDGTNMQSLIDAAGYYNFSAVGVEIQSKDLAENSIVHLDIDGAEHWTVVSKVTEESVFLADSTRGNINMSIDEFNSLFSGKAILLSELNKTNVSNVISNKNIKVLDQSQCLNVKGKGWVRVLVGYKTEWRYGLINTYSWVLRPKVINGHVSYSAWEYVKVKHLSWGKYKVKVPIYKYKYIKNQYEVKGKK

SEQ ID NO: 187 - protein, 376 aa, Methanobrevibacter ruminantium
MWYDMKRRRFYLILFIILLILAAIAIIGTFSSFSDVSGYDLGSDDLSIAVTGDVMFGRKMPGVLDSGASPFRNVENVTKSADILLVNFENPATYSTNPVKGDVPLKADPKYVHLLAEANEIVIASQDNNHALDYGDEGLNDSIKNLKDAGIYVIGAGNNLSEASKPVVIEKGDRKVTVLNYMDADNFAEYASIMPPATANSSGFCAYDSELARKQVAEARENESSIVIAYMHYGNEYSRSPNEYQINMSHELIDSGADIVIGSHAHVTQGVEMYHGKPIFYNLGNFIFDQSNPATHRSYFLNLDLHGDNCTVTLYPTVIVGYLPQFMDADSAKALLAELYPQCDQLKVNDDGTAQLTFKLGNITDNSTQSNDVRLY

SEQ ID NO: 188 - protein, 407 aa, Methanobrevibacter ruminantium
MKITVAGVGYVGLSLAVLLAQKHDVTAITTTESKAEMLNQFISPIQDDEIERFFKEVREGERTLNLHTTTDKAAAYGDADLVIIATPTNYDDVGNFFDTSAVEDAIEWTLKVNPDVLMVIKSTIPVGYTESVREKYGIRNIIFSPEFLRESKALYDNLHPSRIVVGCDDDQMEEGQMFADLLLEGAREEEKRANSLEQDIPILLTHLTESEAIKLFANTYLAVRVSYFNELDTYAQTKGLDTQMIIDGVCMDPRIGGHYNNPSFGYGGYCLPKDTKQLLANYKDVPQTMIEAVVHSNSVRKEFIANQIISRNPKTVGVYRLTMKSNSDNFRASAIQDVMKSIKAEGIPIIIYEPTLDDGSEFSRSEVVNDIERFKRESDIILANRLDCDVLGDVAEKVYTRDLFRRD

SEQ ID NO: 189 - protein, 410 aa, Methanobrevibacter ruminantium
MNLMKITVAGVGYVGLSIAILLAQKHDVTAITTTESKAEKLNQFISPIRDDEIERFFKETRDGKRKLNLHTTTDKESAYKNADLVIIAAPTNYDDVNHFFDTSAVEDAIEWTLKVNPDVLMVIKSTIPVGYSESVREKYGVKNIIFSPEFLRESKALYDMLHPSRIIVGCDDDQKEDAQMFVDLLLEGVRLEEKRSDSPKQDIPILIAPFTEVEASKLFQNTYLALRVSYFNELDTFAQTKGLNTNIIIDCVCMDPRIGGHYNNPSFGYGGYCLPKDTKQLLANCKDVPQALIEAIVNSNAVRKEFIADQIISNNPKTVGIYRLIMKSNSDNFRASAIQDVIKMIKAEGIKIIIYEPILDDGSEFLKSEVVNDLDIFKRESDIILANRFDQDILGDVADKVYTRDIFGRD

SEQ ID NO: 190 - protein, 310 aa, Methanobrevibacter ruminantium
MEIRYKNLLKVFTIFLVLLISCGFASAVSDLDEGNSANIVDNGDLSLSDNMMSESADNCKNLETIEESHTFSEKNTVKDVSYGLSTPIDGNTFEDIQTAIDNAADGDIIELNGTYFGNGSDIKITKDLTISGNLETILDAKNKSGIFYVNSNNVTLQNLKFYNSIVPEYGSAVHFLSNGSVINCTFINNTAGGVYGTIDYFWSTGGVVYLAKGNGSVINCTFINNTANADGGAIYCGVDGGSVINCTFINNTAKELGGAIYIGGGHDGGAHYSNVYDCYVDNCVFINNTAGEGAGIYYGGGGLIFNLYFY

SEQ ID NO: 191 - protein, 757 aa, Methanobrevibacter ruminantium
MKIRYKNLLKVFTIFLVLLISCGFASAVSDLDEGNSANIVDNGDLSLSDNMMSDSANNCKNLETIEESHTFSEKSTVKDVSYGLSTPIDGNTFEDIQIAIDDAQDGDTIQLNGTYLGNGSPIIFSKNLTIGGSGETILDANGLSGIINSSSEKIVLKDLTFVNGSGFTVDLRENNGDNLKYCSIINCSFEKCYGDKNSAVICLNGSGIILDCDFHYTNCTINIMGSEDVSILNSSFNYTGGYAIHSNSSTIVKACDFYFNSFFETYYENTNKVYNGNIVDLCKNSSISDCMFKGTYYETIIDSLVDSNTYQFSTLHVCDEVDVINCTFIRSITEFSGSAIYHFGNGSIINCTFINNSAGGSHGTPSYLYTQDGVVYIGSDDCLVLNCTFINCHSNTFGGALYINARNCYVINSTFIKNSAYEGGAIYLAQGDCYVINPVFSNNKANHSLYNDINDLNAVSYENDTSDDNQTEKIINPSIELDYLDDNLIIIFKDIEGKAISGESVSLIINNKTISVITDSNGEAKVPLNETSMVKAFYVDANGLNVSSSMMIKIVEKTNYIPIKRNSSFIDCKNMTTSAITNSKIRDGEYFVVSLKDANGKPLSNKPIQIGFNGKAYDRTTNENGSARLQINLAYVGTYTFAVCFLGDDYYNGSFVVAKIDVNAQKASLNAPSKTYKASTKTKALTATLKDAKGRLVSGKSISFTINGKSYVAKTNTNGVATVKVSLSKKGTYNFTAKLDNDKTFKTTASSGKLVIK

SEQ ID NO: 192 - protein, 279 aa, Methanobrevibacter ruminantium
MQRSLFDKVKTSLWMLPSFFGLVNGLGFIYLGRKNSNIKWTIEGIVYEIPWLIAILNIFNLSVAITAFSLGSFMVLISIVRSVMVNYEYQRLLDEEYVVRPSVESGSHGLDKQIKNGQFNEKEASPKEEKVKYNPYDLSGIDKNYDGRIKFDKYKAEIKEMEKEFNEKNDNVKELVEKRFSQSGITYDRFMFIIKDSEDLFNSQAANALDMIDLAPEYTETIDAEIRKKMETLRTIIEKNDELRDELIINMTTETGSEMEIKNLFEDMGHLTSSIKHYE

SEQ ID NO: 193 - protein, 638 aa, Methanobrevibacter ruminantium
MKFKNSHILLVSLISIFLLLSISAASAADSDIAADDSSVDIVEIEDINIKESHYLCDDASTGSEDLSGDENTSASGTDDATGGNDTDATGGDDTGNATSVNGTENVTDSNGTNATNGTNATNNTKYDGPVTNATIIPVSTSADYQYGNFTFKVVDNATGEPLANQKISVSGVYFFTFNNGSSISTTKVFTTNSNGLLVIANKNLNKNLDTLGMVYNFTALDVGKYDLTFSGNDSLKIVVNNTLPITVNKVNAEIKASNFKDEVGTSKKYTFKLVNKNTGTVIKLASLKFQIKLNSSGYTTYNSTTNLSGQVGYNLNLLAGTYPVRIVNNDSNLKASTVSRNVTLTKKVGVLSASNRTILYNSAPTAIIKLTDKKTGKAVAGAVLKVRVYTTSKKYSDLAFYTDNKGQVSFKAALSLGKHKMIISTLDNNYTASSITRYVTLKKTTGKISAPKISATYKSGKLYTITLKNAKNGNAMYGSTLNIRIFVTSKSYYKYTGMTDGNGKVNINTSSLKPGTYKVSVSSGDSGFTAKAATGQIKITKIPLKLSPTAYKEKYNSGKTFKIKVTNKNTNKIISGIKVTVKVYTSAKKYKTYTVKTTNKGIAYLKVTQKPGTYKTVVSLSNAYYSASAVTSKITVTK

SEQ ID NO: 194 - protein, 223 aa, Methanobrevibacter ruminantium
MNSKKIAIVLGIILLSFAIVGSASAFNLFGGPTTDFDNKFMSGTFTGDVSRNNISTNDSLSDWVDSYEDKERNITYNMSCIKGGSFLTDLYELQGMAAPEVRNFNGEDWKVYYSQAVPTTDENKTANESSVINVYICEADVDNVTYMINIIAYDNESIDCDGSLYCGFFKDDIQPLLESITLKDAKKAPQIYDLLNMTKDDFKQLQDYIEQVKTGNIPETAEG

SEQ ID NO: 195 - protein, 689 aa, Methanobrevibacter ruminantium
MSNSNTDSSDNASDDASGSEIVSGINEELESNNLLTEDLSVDDVILQTSFYTSYAVKSAKSPTVLTFKNSTVVKGDKLYIYLKDSSNHGISGEKVIFKFSNSSYTRTTDSNGMAALDIKLNPNKYAFSAIYDGSDNYSASRKDFTLTVAKVNTKLTSSSSVVRGRNLYTYLKDKNNNALSNKKISITISGKTYTVTTDKNGRASLKLSLKTGTYSTKINFAGDKTYNSQSLSKKIKIYTLKTVMTIPSTSVVRGQYIYAYLKDSDGNALSGQKVVMKFDKIYFNLKTDKNGRVALKINTRLGKIPVKASFAGSTSYSASSKSVTITSYVEKTKITVENSTVKRGKYFYAYLKDSKDKGISNQKVKITLANINYTKTTDSNGKVALKIEENPGNYTIKLNFAKTNSYYASSKSLKINVLNNATAKIIAKDQTVLGEYSVRLTDMNSNPLANQTVEITAATVNRSVGSGLPITKKTVVINSDNIYNKATDSQFIKSIGEVLKSKGYKVIINSNIGPNAHCTDAMGAYSDVCIFCIFGGVDSGMFVDMAASWYQNLLKKYDNEVVLGFTHTQRNLATDTWLERAHDDDYSPKNFTGLSYPGTYLNDYDMDYVYGRTATEMANNFIKYAVNGLSIGLNNTVPCNVMEYNVTTGDNGYATITDLLPGDYAVISSYINKTAGYVADTVISIIEVK

SEQ ID NO: 196 - protein, 338 aa, Methanobrevibacter ruminantium
MDECKLVLIGFGAVGQGVARAISMKKEMINEKFGISLKVVAAGDSSSSAICQDGLDEELLLKTKEETGKLANYPEYGSDISGIDILDAVDYDVLIEATPTNIVDAEPAKSLTLKAFADGKDVVTSNKGHLALFYKEIIEAKEKAGVDFKFEASVGGAMPIINLCQETLASCGISSIKGILNGTTNYILSRMTTEGMTYENTLAESQQLGIAETDPTQDVEGIDAACKVVILANSVLGIDATYDDVEVRGISDVSLEAINLAKEEGYYVKLIGEVSRKQLKVSPRLVKKNSPFAIDGTLNLANITTDLADDITVMGKGAGSLETASAMLTDLINIIKNK

SEQ ID NO: 197 - protein, 735 aa, Methanobrevibacter ruminantium
MGFLDNVKKIFDSGENKEVKPRNGTGKIDKVESVESKSNYVNFNEKDEQQQNSEDLINDEILDESTSNETRNFTYLNNLIHSGVKEIILDSDIVYGNEDEESRHGIKLNLDNLVIDGNGYTIDALRASEIFICDARNIVIKNITLKNGFSHQAGAINNQGELTIIKSSINNNEGKLAGGILNLGELTLDESVIAKNKAEHTGGILNFFGKLSITKSTLKENIGIGNKAISNNGGELTINKSRIINNQIDTKTNFVNKARTVFVNKAIKARRDAVISNGGYLRISDSEILSNESKYIILNIEFSRIYNTIFKANESQYIIYNDNYEDNGLSSLGIFNCKFIENNAKASIVYNDGNLCSIDNALFENNASHKNSNIITNKSNLTLNNLKIKDNGKNILNDDYIFIRNLSPQIESKIIGEGLAENIKDIKPQEEKFDFGYLDKKIHDNKTGEIILEEDIRFENYEMDYYEGGIELDMDNLVIDGKGHTIEGAKKSRIFLITGKNIKLKNIIFKNGFLYKDYDNLMNNQGGALKTNSNCSLTVENCKFLNNFSQDGGGAIHSKGNVDIIKSIFTSNTVKMFGGGGAINNDGNLSIRESTFTNNSAERYGGAICNKGEISLFDSTLTNNIAKVHIFKTSYGKGGAIYNKGKLTISNSSLSKNTAQISGGAIYNWKHNERYEPIITKQRGSEAMCYEGELIITESTLYNNTAEESDGAIYNEGKMNITDCDINNDSNNKNT

SEQ ID NO: 198 - protein, 111 aa, Methanobrevibacter ruminantium
MMRKTIFGVIFIVFILFSISTVSANDAQVDMLNDASDVELNQDLNAQPISSNCYDNNQNLKAQPISDCSDELQKSDDDLKLSEGGSTSFKQLCEDLNKSDGEFNLTHSYKH

SEQ ID NO: 199 - protein, 966 aa, Methanobrevibacter ruminantium
MINGNNNIIDSSKSNFNFKFSNEANITINDLTFTNFNKSLFVISDSQLTFNNVNFTNCSSNLSLIAIMFPSNLTINNCNFYSNSFANYLDGPFNKLEIYNSNFDGTNCLDSAIKENRGQLVIENSSFENFTGVHGSIINYKGDYFSIKNSKFINSNSNFTGGAIIVKYFPIAYEEGDSFVYRHSNDMLIENCTFYNLSSSSNGGAIHLDLDSGSEGIVETLIVKSSNFTDCHSKFGGAISILGGYLNISYSNFQNNSASFEGGAIYSSWTNAKIEGSNFTANEGSQNAGALYFDKGKLTINDCKFIDNKALKERERTANAIYAHDVAAYFSNSTFDNGGVSVYADFASDSKIENVDKNDDIFLMDNHDYIVSVESKGIKLNLTGNEINVDSLPSHFDARDWGWTTSAKIQGDNTDCWAFASISSLETSFAKASGVLYNLSQNYLQKLQLKYFYSGDKRNSLTGFSYSGPGYALSWYGVLPVDNGYDDRGMIADTDLEDERIHVQDVLFIDTGRDDAVELIKWAILKYGAVTVQRGINGPYGELPTEGDDIAIMSHGTHFISLIGWDDNYFELEEGDDDPLHKFAWITKDSLSGFSTADYTKFDAIDNYAIVPQRAAVAYIFENDIDYHVNYQTDLTGLVGFDANYNYYSNEFVSKYDEFIGAVGTYFNESGIDYSFDVYLNSEKMLSQSGVSEFAGFRTIKLDEYIHIKAGDVFKVVFKSNSIPFQAYSRQHYIEGMSLASADGESWSDLAPLNKTVCLKAYTVKEDKEVSPSRASTKIDCSNMTTTAVASADGRIGEYFVVTLKDQNGTVIANKPIKIGFNGRVYDRVTDENGSAKLQINLAYKGTYTFAIGFLGDENYLGAFEVAKITVNKQSPKLASPNKSYKLTAKTKTLNASLKSGNGNPVSGKKITFTVNGKTYTATSNSKGVATVKVSLNKKGTYSFTVKYAGDDTFAAVTTKAKLTIK

SEQ ID NO: 200 - protein, 82 aa, Methanobrevibacter ruminantium
MNKQNVFALILLTIILLSVVAVSGCIGKSSDNSASDSSGDSDDSSNSIFHSGSDSDDDDNDDNNDKDDKNDNDKDDKDDDDD

SEQ ID NO: 201 - protein, 1024 aa, Methanobrevibacter ruminantium
MLNKKIIIILTFILILSISSASASADSTDETILSDDSAGLINLDNSNNNLYLDDNQFNLANSNSDNSNNFNLDDSNSDNSNFYLDEDLDNKINENIKNTKTILKENNSSIASFSNLSHILSKASAGDTIILENDYKYDSAYDSQYQGGIEVNSITIDGNNHYIDGNGEARIFYLASDNIVLKNIKFINGFNSQGGAIYAKGTNVNITDCIFENNLAPDNGGAIYVEGNASIKSVKFINNSAGYGGAAYINDSSILEDLIFTGNVANIEGGAVYIGGSSNITNCIFDGNLADKGAAIFIPAKESPMTPSEDVPFDESDLNSTDMDLDSTDMDDNSTDYNFTDMDDNSTDYNFTDMDDNSTDMDDYPDESDEDFPDGGDYVFPDWWEGDEFEYDGIECINVFITNSTFINSNDFYRGAIFSEHDNNISIDGCLFENMSSQYAPAIYCNVMVNILINNTGFKNLHANGTGGAMAFLDNVYAIVDNCSFKNISSSKNGGAIFYDSNSWGHSSPVSLIVLNSSFLNCSSDYGGAIVVLGGGFKSKDSSFINNSARYGAGAVHVYTDYDILVYDTVFYNNRLNEDNTSFGGALFIDSAEKAIINNTRFVNNSNDAIYAYESRIKINNSYFENNDEYLRSIYTEGLILGDNKYNDDTLVDLDYDPTYIIIGTGEGLKLDLINNTIDVTTIPSSFLAADWGWMSPFKNQDFSGGCWCFSTCAAIESALLKSTQKTYSLSMQNMQKLSTEYSKYGNNHIVEAGSTIVALHYALSWMGVFPEEYDTFDMIGKLSRQISTNETIHIQDAAFTYPRSISYDIDQIKQTIMKYGTVTSDFYAVNEAPNFNENTSAFYCNETDGRDATHAVAVVGWDDNYPASNFLVTPPGDGAWIIKNSYGEENYDHGYVYVSYYDTVFNIDGGVAYLFENTENYTKNYQTDIGGDIFLVNDSDSYSYKNSYQSIGDDYISAVGTCFNDADEDYTVEIYVNNVLKTSQSGKSPFRGFHTIKLENQIQVKIGDNFTVVMKTHSVPIVN

SEQ ID NO: 202 - protein, 163 aa, Methanobrevibacter ruminantium
MGVLASVAGGIFFEAGMIATCTGVGLPVGLALMGVGTICTAYGSGLFGMTDTGNFYSNLTDENLADFGFSMSLNLIGGGYSAAAAKSTLRTVGGKSVQISISKAAFASDQRGAYTTFHTISSKTYIQKVENGAFSNCGEYLIEQEFGTTVIENIRKSLRVFIN

SEQ ID NO: 203 - protein, 1024 aa, Methanobrevibacter ruminantium
MFSVSLNKLKIGRVFICLFILVFISCSINCVFAVDDLAFNDTYYSDLDSVNGDYSGFLSEGDFNGGSSVVVDGEIDSSPIANNKKNSSFALTSKKDSSSPSISTSSKNNKNNKNTSSLKENKTAAPSSQRVFYDRDIVSDEDVIGPGHENLDWINLTHVDDSLFSDNSKEDGAKGSKIATTIVASNLVKYYLNASQLNVGLKDSNGNYLSGKTINFTVGSASYIRTTNSSGRCSLTINLMPGVYTFTIRFLGDSSYSPSSKNVNVTVLKMPTSITASNLVKYYHNSSSLIATLKDTHGNPLSNMTVTFKMGSNNYNRTTNTNGKATLALNMIPGNFSVKISFTHPRYITSSKNVTVTVLSMPTSISASNLNMTYGDGSYLNATLKDAHNNPLSNKTIHYKLNNTIYNRTTNNNGQTSLIININPGTYQFNIYFNENYYQNSNKTATVTVNGIPNSIIASNLVAYVNESPTIVATLKDANNNPLSNKNLTFNRTGTLTNILTNANGQATYNLNGCTGNFNIKITFNTTGYAFSSKTVNVNIKFWPSTITANGATTYFTDTVQLSACLKGENNTPLANKNVKITYANKNITRTTNSAGNVYYDFNENVGTYNVNFSFKENYYQNASKTVTVTVNKMPTSITASNLNITYQDGSSLIATLKDSHGNPIANKTVNFKMETNNYNRTTDANGRATLALNMIPATFNVNITFSHPSYQTSSKSVTVTVNPISNSIIASNLVAYVNESPTIVATLKDANNNPLSNKNLTFNRTGTLTNILTNANGQATYNLNGCTGNFNVKITFNTTGYAITSKTVSVNIKFWPSTITANGATTYFTDTVQLSACLKGENNTPLANKNIKITYGNKNITRTTNSAGNVYYDFNENVGTYNVNFSFNQNYYQNASKTVTVTVNKMPTSITASNLNMTYQDGSSLIATLKDAHGNPIANKTVNFKMETNSYNRTTDANGRATLTLNMIPATFNVNITFSHPSYQTSSKSVTVTVNEIATNLAVSNLNMIYMDGSHLAATLTDG

SEQ ID NO: 204 - protein, 987 aa, Methanobrevibacter ruminantium
MGGEIINNEKLKLILILTLIFSILIMNTVNASDNGIIAEYADISTIPNDEKVSINENDYDTNYYELPDKKLDHLESNDNQNHLEMNDKKLNDGNSNNDFNYIQELINSHKDGDSIFLEDKTYIGNGSPIIINKNLNIYGYGYKNLSDLDIKTILDGNSKSNIFIINKGIQLNLYGLSLINGNTSYEDGGAIYNNGLLSIDSCSISNNNAGGGAVYSSEGSEIEIYNSLFENNSGLLGGALDLENANAIISKSTFKGNRCNGDGGAIYNNIGKLTISNSTFSFNKGARGGVIYNNHGTLSIYDCEMFLNSASQLGGTVKNWGSCEIYNSTIKNNTADMYGGGLYTFEFKMTVNDCLIENNYADEGGGLFADADSRLIVINSTIINNNAKIGGGIDAKQAYLTVNNSSIINNNAKSNGGGIYADKHPAEIHNTNIKDNNGNSGGGVFIGDISAKISDSTLNGNSGETGGAIFNKGKLIIEKSTLNSNEANYGGAIYNQKNLTVNKSSFDSNKAYEAAGIYNLGDFLIESSNFTKQSVSHKAGVILSVNGNIKIKDSIFKQTSGADEGGVIFTREGNIFIDSSLFLLNNALSYGAAIDNSAIMTIQNSLFSRNKAFGAGAIDNGGDLTVTNSTFTNNKVTNNGGAIDNNGKLYMSGSVLVNNTAQNYGGAIISRKDTNIEYCQILDNSAPEGDGLYDSGDYLLISNNWWGENNPNFDELLNFNIDEDFKWIEMNFTNSTPLMQKKVSNLTISLNGKDKNNNSFKLENPDKLPILKSSIQVVSEDSKIKYNLNIVNGSASTSTDMKLAKTVNAILDNEIVSLDVLENNESDDDSEDSDDSNDSNDESDNPNNSNDNSDNVTDDSDDSNKSNNPNNHQSNGNKNNDNNKNYYNKNGLRYSKMKNSLLNSIDSNLDNDYLNLKENNENNDDSNSNNKDMNYSDKKTDLNNESSNKEIDENETKLFDINYSLLIIPIALILLVLFAFRRKNKDD

SEQ ID NO: 205 - protein, 148 aa, Methanobrevibacter ruminantium
MDKKMIVSVAFLLLILAVALVSVFDESNSSESKVNLIVYSEGPKSLSELVNEIKTQDYYEGYDNETVAWMESLGNKKFYYGDGIIVIMSATDASKLPSLYVTDVELFEHFECNVLEKRSLGNVEYPKDVLYVKNVKYIGEEYGNFSGA

SEQ ID NO: 206 - protein, 39 aa, Methanobrevibacter ruminantium
MKISRIIVLLMILIFTAGMVYAVDLSEFKLNLSFKFSSP

SEQ ID NO: 207 - protein, 161 aa, Methanobrevibacter ruminantium
MDSKKILVILGLTVLAIFLASSVSAGDLISTGGYNPDSLIILEGADFNIPDGFERIEDKSIANQTRNSGVFSSILNREVYGNPKGEEIVISVVDFDNFDANLPILSMICKGCQKKELLGYPGFIGSDGNSTKFSYVFDNKVVSISAPNEDLINQVLVVEDA

SEQ ID NO: 208 - protein, 315 aa, Methanobrevibacter ruminantium
MKPYVILIGSASGIGKSTVAAELAKTLNIKHLVETDFIREVVRGIIGKEYAPALHSSSYNAYSSLRNQENYKNQAELINAGFEEHASFVLPAVERVIDRAIKDHDDIILEGVHLIPGFIDIEQFTDKASVFFFILSSDEEDHKNRFVKRAMEIRRGGKQLDYFKENRIIHDHLIEQAQKHNVPIIKSYEIESTVKKMLSYINETCETIYLKNTVDELDKVGEIILDRYSGSIKNISYPIKGFKEPLIRKIDVSEIREYDKFIKNLNKFPEKKEELKELYSLTDYRAYRICAINNETIEKIKNDLDKEGLLFKEDM

SEQ ID NO: 209 - protein, 130 aa, Methanobrevibacter ruminantium
MLISVLGVIVIIIMVVAAAYVGFSVVSSSLTGGISSGTQYDELATLKSNCSSLEAQFNITGTKIYAMQNITLEREFVNAQVELIKVQNDLDSVESALASGQPASEVDKRIQQSKEDLKIAQQAYNSLSVK

SEQ ID NO: 210 - protein, 57 aa, Methanobrevibacter ruminantium
MATRTKQTICRLYSFHGGRFLIALSVFPLNVSCGLLFDIRSPPEKKFGIVFLNFFSK

SEQ ID NO: 211 - protein, 97 aa, Methanobrevibacter ruminantium
MELSKSDKYLIVVGIIFCLALAVLSPYIASGDPDGLEKSAEDANVGEDVEAPVMEAPFPDYTYEPLEKIGEIGVLILGALITLIVAWGIGYALKRSE

SEQ ID NO: 212 - protein, 338 aa, Methanobrevibacter ruminantium; identical to SEQ ID NO: 42

SEQ ID NO: 213 - protein, 808 aa, Methanobrevibacter ruminantium
MSVILILFLAVSTVAAIDVDTNDNLDDGSSSNSDLISSSSLDSSSSDDVSSGSSEVSSSDESLDGNNLSDGNVSSSDESVGADNLSDGNVSSSDESVGADNLSDDESSSDALSEELPKTETVIKADPINYNYASVKGLTINLTDSAGLALSNKTLTVKVSALNKTSNLTTNSKGQAIFKLSASVGSYDVFISFTGDESYAPSNASSKITIKKSSTKIKLSNIHGYLTISNYVSVTLLDSAGKPIKSKSVTIQVNKAKYNVKTDSKGIAKVKVANKIGTYSVNAKFSGDKNYYASSNSSKLTITKMKVYIKAPSVKYYMTNSSAPYLTINLTNVKGSPLAKKKVSVKIGKKTYTLKTNSQGIAKFKFTKKVSSYNCKINFKATSNFYGASVNSKMTIQKMPTSLKAPSVSINSTNYGKVLISLKDGKGKALKNTTVTVNVTELKKVFTLKTNASGVATFSFNGEKTFNLKIKYAGNKNYAASSVSSKINVKQIKVKLSDVIGASRVLIDYVNRTKDLPSNVQYNNYNFTVTQLTYLASKAVKNINNKNYGDIVLISVPKSYKSSGEIYDTVYKKDFVKIANSVVGSSYNYKNKEYVSYSIYKVPFKVYSISFAKVLNFYGNNKKLPNYSLFTLADFAKVKDNGGYNFYLTTDNIAGKKSDLNMLKSLAKTLKSMGYNAVIVGIGPDIHNVAYRYGCTGNNSVLLACFGGVDVGCIEEWAGDLGDLNGHSFVNSYQGAHVLGLWFTKPYGASVSLNKKVGIAWDADYGFPLNTPAKYMKSHNISYIETGTVANACKLLSEGKMGGPQLIS

SEQ ID NO: 214 - protein, 241 aa, Methanobrevibacter ruminantium
MNKKLKIILYILLALIIIIAGISLWYLMDYSPASADANSLINGTSEVSVSKINNGLFLDGPGNDSAVIFYPGAKIEYTAYLPLLINLSADGVDCFLVEMPFNLAFFGTNSADEIINNASYNYSNWYIGGHSLGGVMASRYAHNHFDKIKGVILLAAYPADSLENGSVLSIYGSNDKSLNKESYDDAKKYMPSNFTEYVIKGGNHAQFASYGNQTGDGVATISAYQQENETIKDILLYINGS

SEQ ID NO: 215 - protein, 201 aa, Methanobrevibacter ruminantium
METKNLIIICATVILAVVIVLSAFIYVNMGNETHISSNIADTLQNGDEIVVKLVDKDNKPLVNKTISLNFKDENGKGNAVSYDLLTNDKGEVYYNVNLTEGKYVFSADYAGETFIGSSSLNKSVEVKKDVKTANLSSTDTTKTAKTKTYTDWQEDYETGRYDEDGNPIYRSIMSTSGGQYEPGIYECYWSANGPISERRIG

SEQ ID NO: 216 - protein, 222 aa, Methanobrevibacter ruminantium
MIIKNYSNEPTDEAKVDSSLYDAQLIGENDLGTVHLHGPFGNEESDIKIAYLIGMHPLESKAHRALFDTVLDKDGDLNYSYYIYNINVIGELDEATEGRMDGQLLAQEFVAHHIIDRGYDFFLDIHSNRGSRSPGTYEISNFLFAPGFDEESSKYMNVLLSKIDELVYYAPEYRTSPEFITVPVQKSGIPTLVYETYSYEPIELTYELSEKLVDAVDSLDFD

SEQ ID NO: 217 - protein, 253 aa, Methanobrevibacter ruminantium
MLVLAFAIIFLGYSISLGNNQTAGVKLNDSNKIYINQSYPAEPIPDAKIDTSGVNSVLLGQNELGSVELLGPFGNSDSEIKIAYSIGMHPWESKVHKALFDTVLAKNSSLKYCYYIYKINVTNYNTDDEGRMDGQLLAQEFVAPHIINGDYDLFLDIHSNKGTVGGTYEQTNFAFAVGQDEKSEAFVKKILDKMPELVYYFPADQSSPPYITLPVEQAGTPTVNYETFSYEDINTTYDLIDKLVDVVDNLEFK

SEQ ID NO: 218 - protein, 132 aa, Methanobrevibacter ruminantium
MELNDEIIFKVALITALVGMIGMLAFASYIEPKEITINEITRNNIGETVSVSGVVESVKLSSSGSSCFLELNDGTGKINVIVFESVLVELKDAGNDLNDFKGHNIKVVGSITEYKSSMELILANSNSIKLES

SEQ ID NO: 219 - protein, 256 aa, Methanobrevibacter ruminantium
MKNYFDIKDKVAVVTGASSGLGWQIAQAYASQGAKLALFARREERLQENVKEIEDKFGTEVMYAVTDVGDYDSITASVQKVMDAYGRIDILVNAAGMGNNKMVVDQSNEEWARHIHIDLTGVYYMCKAVGEIMIEQEYGKIINIGSIHSRVIFPGGGISAYSSAKGAVMNLTKNLAVEWAKYNITVNAIGPAVFETELTVDSIEMDGFMDLIAAYCPAGRLGKPGELDGLAIYLASDASSFCTGQLICVDGGWTAI

SEQ ID NO: 220 - protein, 42 aa, Methanobrevibacter ruminantium
MTFNNLRINIKDCMVIFVVFTVLLLSILAVSAAPSPDFMLWV

SEQ ID NO: 221 - protein, 1024 aa, Methanobrevibacter ruminantium
MISISAISAADDSSIATDDSNKIINDNNNQDIVLEENGPSTNIALEDKNYKIEKPQLKENSPGNFTDLNYLINEDETTRHNTTITLDRDYIGGEKGIRIDRPLIIDGQGHTLNASQNNRVFHITSENVTLKNIIFTGGRSDYGGAIYWQGDNGKIINCNFTYNTATKYGGAVFWGDDEFEGTADQTIAKDGIIINSNFISNKANVGNGEAWENGGGGEGGAVYWYANNGTICNSYFHNNRAGGQGGAITWKGNDGIICNNTNFTANSAGDSGGAVFWRGDNGTISNNCEFNNNIAYGRTSDGISRGGGAIFCHGENGKISNCSFMENSAKPESESGKGGGAIYAEYNTFITDCIFIRNSADYYGGAILIFRTGDVYRNIFINNTALNGNTITLKGIGHSTITNNIILNKTNAIYWNESDYTIEANWFGNNATQYSEPYEYSQTWLFLNATANPNPAPFNIPTEVKFKLWLYNKKTKKITEYDNSLLPTIQLSLSQTKGSINKETAGLDDPINYTANEVGTGSITGKMEWITDSIFFEIVNDPKLEVSVNPSEIDYGDNITLHLGYEDEATGTVNISFKGSTHEKTIENIPLNKTITITESILPDEYTVTVFYSGDNQFSRASKTADEKLKINQKNPNMTVTSYEIYVNDTNGVMFSIKLDKDATGKIILTGDIGREINLTEGSIKDGKRIIEIKNNGFDLGKYNVTFSYPGDEIYWEYETTALSEIKVIETKIIPQKEEIVLIIGDKSKINYTINPSNAVGDVTFTSNDTNVVKVNGSGDIEAIDKGQATITIKFSGSKDYAPSNATVNITIGREMAKLTAENITVTYNAEGYLKVALKDSKNKSISGAILIVDLINKTNYTTDSNGEIKVPTKSLAAGNYTASIEFEGNDKYLPANTTAGVTIEKDNPRLTSNNITNKYHTEDYLIVSLKDSASGPISGAELTVYLNGSETYKTDGNGQIKIPTKDLLPNIYVANISFAGNENYTEANASASINITKLDTRLNATDTITKYNVNKDMIVTLKD

SEQ ID NO: 222 - protein, 463 aa, Methanobrevibacter ruminantium
MKFKKYLFILLIALICIISVSAVAASDANDPISQDNNQGLVLEETNQDLSITKTKEIVESSTNKEISLEDNKVISKENKKTSLKDEETDSFTNLNNLINIDNPNNHTISLNCDYVLLEEDCTYIDTEILSSSNLTTSHILRDEGSLPIDLNPKTYKARLMVENSNDQSIEVIKTTNIEGSSFWLLNQTINNNSNSEITLDSNYTFNSSADSGFINGIYINRSLKLNGNGITINGLDEGRIFIITADNVTITNVNFANGKSDKGGAILWLGKNGNISNCNFTDNMATSGGAIFWGNTNLTDYYSNGQGDDGTIINCNFIGNEAQKGGAMFFHTGGATIKDGCTFHNNTGGQEGGALFWLNYGGRIENNCNFTFNTAKGSGGAIYCPQVEILNNCIFQNNTAQSKIEERIMKGGGAIYLQKGGTVRDCTFIGNIALNDESDGLRFYKGGEPFTLKGMPPFPTAPS

SEQ ID NO: 223 - protein, 300 aa, Methanobrevibacter ruminantium
MYISEIEINQNIILNTEGNKIYLNNSPKSNIHDNWFGNTLLNYDEVPYEGCTNWIFLNGESNQVSLENPISFEITFTLSSFNKNTKKISNYDDRKLPFNLTAHAEHGILNPNSNLLGKTTIYETEIINVERIIGNIANIDSEFEIMEFLVTDGTTFYDLNQLINNNSNNEINISGNYTYHDDIDFEFKEGINVNRSLIINGNGFTINGLNSSRIFNINGDNVTINNISLINGNGYEDTYDSDGGAIYWKGADGTLIQSNFTNNSGYNGGAILWEGDNGRIINQHIQKNKQRIRMEEVPSP

SEQ ID NO: 224 - protein, 1024 aa, Methanobrevibacter ruminantium
MICYADNLSMINNTMESNIASDDNGGAILWEGEIGRIINNTFKNNYASEEGGAISIRGEIGEIINNTFTNNNASYRGGAISIIITSGEIINNTFTNNSGYSGGGILCYGNNVSIINNTMESNIASYDGGALYVSMDYAMIINNTIKNNNASDNGGAIYWDRYKGIISLNTIANNNANHGGAIYYEGYSSNLNYNIILNNKNSEIYFDNVRTFNGSNNWFGNNASNYNLNPNTSFEYDNSPNVTLSDWLFLNGTANPKIVNAFESSQILFKLYSYDGILISEYDNSLITDTKLNLSAERGRFDKTSASFNEPINYTAIEGGRDTIRGAIDKSGYSINLTNRRVSSKIAMDTKEINYSRNASIKLNYNDFAGGNVTIRLMGENNEYLFENMTLNKTIFLGVINRDSYNVRIEYSGDRSFLEENISESLIVNKAGTKIVPTNDTIDLGIGENSKVNYTFYVIDDEGQYITNPEDIGNISFKSDGSAVEVDSKTGEINTIKEGTANILIRFQGDENHLDSNASVYVISSNKIRTKITAENLTTDYKKDDYIIARLTDLTGKPIANAKLIVELNGTNNYTTNSKGEIKVPTKGLDSNEYIAKIIYEGDESYRFSNASVRLIVNKLNTEITANNITTIYNITKELVIRLKDVNGDPVSGVELTVDLNGMNNYTTDDNGQAIVEIKGLIPNNYTAKITFEGNGNYNKASTESDIEILKIPSILNGTDMTVNYKEDKYLTVSLKDKDNKPIHNASISVELEGIKNYTTNSDGQIKVPTSSLPAKNHTAMIRFEGNEIYEKSNATAKITVNKISGKLTASNVTARYGDNQNLVISLKDSKKNPLSGFKVSVDLNGKKNYTTDSSGQIKVSTKDLVPDTYKAIIVFAGNENYTGSNASASVRINRINTTFKYTNMNTIAFDSNIEGRIGEYFRFQLLDEDGKPLSGKQVFIGFNGVKYNRTTNETGEARLQINLKYVNHYTFAIAFLGDDYYKGSFNVALINVTEQIPVLSTSAKTYKSSAKTKTLTATLKSSR

SEQ ID NO: 225 - protein, 168 aa, Methanobrevibacter ruminantium
MDKKMTVLLVALFCLLCVGSYLIFEPARHISYHEVNLTDTCVAKVPVTDKVSSYTDNLNIHYYSDYENDLNITSFYDVAPESSSQGHLRMDNLKKEVLGTEKGSAGNLTYYKNNNAGTYTMYVEDRMSHNYILLSAKDLTIFTNVYSSLEARIVVNETDIDSLDSSYA

SEQ ID NO: 226 - protein, 159 aa, Methanobrevibacter ruminantium
MDRKDIIIIILVLIIISLLALGLHNHQVTDQGTDLYRTVKVSPSFSLDVPLSSNLTRENVSENMYIVNDYQNDIQIISFNMKNASKMDLIEDGYQYLKREESYKFGAEEIIKISNHTVWHNKDDGSYIAFFSPNNTEDNIMLVTHDNITMARILSSARY

SEQ ID NO: 227 - protein, 401 aa, Methanobrevibacter ruminantium
MTSEIMILTPTAVVLAADSAVTISDIKTYDGANKLFYLSNKPPMGALIYNLADFVDIPIETIIKEFRRKIDGKEDLSLIEIKDEFEKYLHQIISKSRSTLSFQEQLDYFIEFIQEELSYVDFDEFKIGLKDELSDFDIGLLGDFKDEVQSQIDLYEDKFSLALPDDCNGLDEEDFISDLKKLFICNMFLMPFIGIAISGFEKDEMFPSFIHFKINYLYDEEFLLRDVEFGSIGDEEVILKALAQDDVINTFLNSIDSKTERALEDFFIEFKNFLFNYIEYCIKSNEDISEENENFLLENISDMEFSDEKVRNIFIGFIECLKAKQKKPILDSISVLPKGELSNLADSLIGITSLRRKIEDEVETVGGPIDVAIITKGDGFVWIKCHDSFDKDLNPQFFDSN

SEQ ID NO: 228 - protein, 1024 aa, Methanobrevibacter ruminantium
MGFKRLKRLFSSDNDNEMEKNEEKNKSGEETFYEESDEKAFYTEYDDSGFILDNNSDDSFNNGSDDDLSLNDGLKEDLNGSDDNLSLNNGFEEDSFGSDDDLTLNNQPSSNRNFNYLNNLIHSHQNEINLDSDIVFDSQMDNTYLEGINLDMDNLTIDGNGRTIDAQKKSRIFNVLGENIRFTNITFKNAYSNEDGGAISIGNYSSVYFENCHFISNDAGENDGGAISIGENSICTIKDSVFKQNKADSGGAIVNEGTLKIMSSNFEYNSSQVFGGAIYTHHSKVEIAYSVFKNNISSSGGGIYVLFDCDMIIEESLFIDNASMSEGGAMANEYGGKIRIHESLFRNNHSLIGGALCNKGSPVDDGKNLVSVSDSKFEYNSSIENNDTIYSTGVLKLEGNTFNENDRILASNNPEIINSKYVEATEDIIDLAKSIDYSIAGESNLFELLDSDIRNFNYLENLIRSSGGEIILDSDIILGDDEDYTDGIRLSNENLRIDGNGYSIDAKSRSRIFSISQCNITFENLRFKNAYSEGNGGAIYSVNSFLTFKSCSFENNSSDNGGGISTENSTNEFKTLSTENNRNEFKTLLFEDCSFENNSSRSGGAISTENNDLILKTCLFDRNESNLGAAIICQNGKVRLDNCGFKENIASDGAAIYYSSLPIGTYINDDSVNFLEINDSVFEANRLTGTNLTVSIIDCDCSISFNSLSFKDNKFDYGDLINQKYLENKNSIIKSSKFIGNGGGITASNLKVISCEFIDNRSNAFSSQEYFYDGSSEIEDCTFKNNHCAISSHESSLKIKDARFYGNDSAIMNRGKAYINDSRFRDNSMAIENSANSYMFASNLNLLDNASGESHDMINQGHLSVIDSDFINCNKTLNLICQEDNEDAVLDIEGCSFKTDSKRPISINGGSSSILYSRFELDQSKIAIFNDSKLNIDALSFKDYEGNDLEGKLIYNNDYLKSKTRDILDKIDSSESAITKYAYETLPADWKGFDYLINLIKESNGEVKLDCDILINDIEEDYYG

SEQ ID NO: 229 - protein, 672 aa, Methanobrevibacter ruminantium
MRKKILFLTLMILICFTLNSVCAQSLDNINYANDGFDSDEMINCDLHKDSSQKSLKSNALSNKKTTNTVKLTDMKKAESNDVKQTGAAKASNTKSTSKSTTKTNATKSNTTKSTATKTTANSSSTKKATQNTTTINTQTLAKSSSSYMAYVEKNAKLQEPITISKKKYKSPEYLYLVSKAVSNISKTKVEIKDKLITNYSNTDCKSVNGTINKTEYVQVAKKTVSFIEKNHRAPNWIASSKGNIPRNQLILVFSKCLDQYNKSGKLPSSIKLNDLDLNKMKQKIDSSKKVNSTSTKKTNTSSTKTNSTSAKKTNTTSTKKTNPTATSTNNNKSLVESTLDSIKSILNNIENKLNPTNKVLSTTGTKKNTVTVNSSKVNVQISSSSTVNVKISAKDNTNSGKNTNSGSAKKTNTTSTKKTNTTSTKKIDTNSTKKTNTTSTKNNTSSAKKTNTTSTKNNTSSAKKTNTTSTKNNTSSAKKVNTSSSKTNTSAKNNTSTTAKSSSNSKYLSTSVLNDKYLGESLKKYLAVGKNCQVTNKAIKTLANTLTSKLKSDYKKGEKIFNWVRDNIGYEKYRNTKKGALKTLQTRGGNCVDHAHLIVALSRAAGLPARYVNANNCKFSSGYVSGHVWAQVLVGNTWVVADATSNRNKFGVVKNWNVNSYKLVGKYSSISF

SEQ ID NO: 230 - protein, 778 aa, Methanobrevibacter ruminantium
MIAGVSASDIMDASDNPNNDDSINLVSQESGNDQISNEAISVSNSLSANDDSYSPESEKISSKIKTSNNLSASNSTKTTTKAAAAKTTKTGTSLQPSSTSIYSGQYLVITLKDKNSKALSGQKVLINISKFKNTYTKTTDSKGQVKLAVNPVGSFKLVVSYAGNGNYSSSKYSGTLKVSKSDTSLTVASTSVTMTTPLVVTLKNKKTNEALSGKKIKFVMDRVSYSRTTDAKGQAKLKVNMKYVFNVTVKFDGTGNLKSSKVTKTIKPTKIPVSFVYSANSVKYGHSITVSLKNNLNNKTLSGKKIVVKTSDSKKSTTKTTSSKGTISVPINSVGDVTVSLSYAGDSSYKAASSSKKIKGLKDSSKITSSTGTIPVGDSYTVTLKDSSGKALSNKKIVFTFDGKSYTKTTNSKGQASLAISKGPGTYSVNVSYGGDSYHSGSKLSKNVKTSNSMISIANVIKAATTLRAHVDYTNRFNKSYVVTINGLKYSPDEFAYMMSQAIVKINNGQKSGYVTFKNLTGDYDSKGSSINGNLMKKNYISLANTLISSVNKNNKIPANISTNLGKIEANLYIFGLAKALQFYGEEKYLPKYLILKNSFIKGSSSTTVTQKAKILNCKEAFNATEFEKYLKTGGKSALNSAIVAKAKSLTKGLTSDKAKANAIFKYVRDKVSYSYYSDSKKGAAKTYKTKSGNCCDKANLIVAMCRSVGVYARYSHAQGCTFSSGLVAGHVWAQTYDRATQTWYTADATSSRNSLGKINNWNTKKYSQAKNYVLIPF

SEQ ID NO: 231 - protein, 1024 aa, Methanobrevibacter ruminantium
MLAIPAGFAADIESNSHNNLDDSNTVNFEINANSKDTNLESNLNTGNLEMNSNNTNLDMNSNKARLAMNSNASDLETLGLTRGEFENGSNNPSLEYSSNSLSDNSNNKYISPSSDKNTYGSNKVGDGNVNIYYFDASASDDTGNGSLERPYKTLKNNRIVENSINYLANGVYNLDATINKNNISFIGADSSRTIISYASTAFITNNILNFENITLKGLNIQNRGNLTARNTIFIGGKGYWDRSYNNIFGGAIYTPQNENYTTIIINCSFINNTADYGGAIYACGGNVTVENSSFINNTAERFGGAIASENTLTNNIRNVEFIHDVSLNDAGGGLFISFTQLNGTDLHFYNCSADFGGGITALYSNVSLNRFIGKDNKARYDGGAIYQFYCSLLIENSLFANNSANNGGGLYVDNSNSLKVTKSNFTQNNATEKGGAIYSLWNTLAEGNSISNTRFNNSFSNNNAKNYSNFYEGKDVNMRIGSGNVTLYHRNETEIDEIPSYYSLIDLNQVTSIKNQQSGGNCWAYASIAALESAIIKAGGEALDLSEESMKNLIVLFSDYGYPWLTNNGGNGDFANAYLTSWLGPVFEDDNPGDDRSYLSPVLNSRIHVQNIQYLGRNNYTDNDRIKEAIMKYGAVATSYYMDNSYYNYRTSAYYCPSATSSNHAVAIVGWNDSYSKSNFKTTPQGDGAWIVKNSWDTNWGDNGYFYVSYYDILIFPLGSMDWGHAYVLNDTIKLDKNYQYDISGLTDYFYNASSTAWYKTKHTADEDEYLAAVSTYFLTTTDYTIFIKVNGEELYNQSGNSEYGYRTIYLNDFIPLKAGDVFETIFKINVSGETGIPVSEGSAFNKVLYDRNQSFVSYDGINWLDIYDIYWTYNSDVYGSHYYVSAALCLKSFSFINEIGTNLTLEFNYSLDNEGDRISPVNIIAHVINEYGFNLDNGQVKFIINGTETIADLINGYANISWNFTDIENEVYALFEKTGYLSSSANETATLSEKYVTLDLNTLLSEDKLTITVDSSRKINETL

SEQ ID NO: 232 - protein, 1024 aa, Methanobrevibacter ruminantium
MRLRYFAIISLILLIFLVPVSFASETNLDSIELNDLADSSTEIDDSTDLNQDYSSNQDLSLNQNSDSNLSNEQELYSNKLSENSLDSNSQSSNDLSNSLYLSSNGVRLADLNSSFAQFNTSLNDSNTIYVNSSYIGSDEFGTQSNPYKTVLAGINAATTDLNNVYIANGVYNINTTITVLKSINIIGESLNVILNASNENNILSVKGSSVEVSIFNLTFRNGYANKGGAIYVDKSSLNIIGSLFDSNIAYVTSDNGYGGAIYNNAGFLKLYNTTFKNNKVVAAYNIVSEGFGGAIYNELGEMTVLNSKFYNNSIDIRNISKSSYGAGGAIFNRAGFVTIFNSSISNNSIYTNYSLGGAISIWASRNVYIINSTINDNIISGSYGFASVISNKGTLLQIENSTISNNNINASSVENSTIYNINGNFNLINSKMENNKIKTIKTNLLMCLEDQLIVNSSFNLANELKGLNMTSLPSHYDLREEGLVTAVKNQGSSGACWAFAFYSAMESYLLKVENISYDFSENNMKNCMGDGSENSTDWDDGGAYVVALAYLLRWSGAINETDDPFNARSKVSPTNLTRVKYLTDALYIPLRLGALDNDQIKTAILKYGAIFVPVYSNIIKANSKSGYSDIQYICNHAVAIVGWDDNYSASNFKDTPPGDGAFIIKNSWGTSGGEQGYYYISYYDASFAASIETSAAVAVTNVVNTTGEYRNNYYYDTFGNTFETIGYNSDTIWFANQFTAISDNPLNAFGLYTYGDSTYTVNITVNNKSVYTSSGKIVGAGFHTIKLSRYVPLTKGDTFRIIVKLTTPSTLFPLAVETNYSGFTPRAKSDYNQSFISPDGKTWYDLRNSSNNRAVKFYEDMYFYTLKNASVCLKAYTAFADELELNLSSNSPIYYTGDTIKLNLTVTNRGDLASNSSIAVPLDKSYSIVSYKISENNGNKSYDIHYNGSSFNMASGIWSIPYLENEESVSLILSLKMNSNNDVNIKVSANSSSCSVKDNVYANISLKYKIPSKFANIPSINTTA

SEQ ID NO: 233 - protein, 1024 aa, Methanobrevibacter ruminantium
MFIGLLLIGLLIIPISFAGDADSYSAYSGDSISLEDDNSYLESNTVLKDSKNSLQSIDDDCLIGNRTLDDTSYSDSTNSEDLTNPDSTNPDSTNSEDLTNLESSANTDSSSEIKTITKSLNDQNTNIKSLNYDEYADYINLNNQLINYDFAISDSNTIFVNASYTGSTENGSQASPYKSIYSAYNYAFGLSSDTRTNVYIAKGVYTVTRRMTINKNLNLIGEDSLNTIIDCNGNGAFFISPRRSYTTVYSPLLNIFNLTFTNGRYSSGGAIYINESTVNFVNVIFKNNRAEASYYGSVEGGALYNNKGFVRIYNCLFENNTANDTSDACGGAIYNDMGEMTIMGSQFINNTAKGENAAGGAIYDFSGILVIFNSTISKSSLLSNYSMGGGLASWSSHNIFIINSTFDSNEGHGKYVFGSAIANKAIMMYIENSTFSNNLANGTSDKNGTFFHLNGVLDFDNVNFTNNRAINPKEDILICLEDQFIISEAFSQEDIAEILSEMELSQLPSSYDLRDYNLVTSVKDQKNSGSCWAFSTLAALESYLLKYENTSYDLSENNMKNLIGAYGLNGTDWYDGGNHYMSLAYLLRWSGPVNESQDPFNDTSHNSRTFTNIVKQVEDVLYVPLRLNYLDIDQIKAAILKYGALYTTLCSDDSFDNNPDYYCDVISISNHAITIVGWNDSYSADNFAVRPPGDGAFIIKNSWGPSEGYDGYWYVSYYDKTLAGYGYDAIAAMAFTSVANASTYKNNYQYDTLGNTFESIGYGCSTAWIANQFTALNNNPLAAFGLYTYGSSSYLVNITVNGISRLVQEGNVKGAGYHTIKLDDVVELLSGDIFKIIVKLSTPDSNYPVAIESKRSDYSSRANSNPGESFISFDGQNWQDLYEVGDILKFYMYMNNKTFTEPNICLKAYTIGPSDVHLHARANATTYTQGDTVEIKITVSNEGATVNDLNISMKWNSSFFLKSFTKLNGEFDSTKKIWHFDTFSEGQSSTLTLVFTMRGNNDVASLSYDYNYSGFNPGDANTTQ

SEQ ID NO: 234 - protein, 831 aa, Methanobrevibacter ruminantium
MGIFDKVKSAFESSKNFKYLDDLIHSGLNEIVLDDDISLSKNEKNKYSNGIEIEIDNLVIDGNGHAIDAQGNGSIFLCTGKNIVVKNIHFKNGIHSNGGAIENRGELTIMDSTFDGNNASLGGAVFNDGPKLMIAKSTITGNIAKEGGGAIYNNDGEVYISESMINENVSSFHQYSGGAIYNKGELTIEKSTLIRNHASFGGAIGNIGQLNIIDSTISNNESSGDGGAIFNDNASLSISNSMIEANVSDGLEGGGAIYNKEGELNITGSVLKQNELVGQIGKGGAIYNNGGNLNIAGSSLCNHSINFFGGAIYNDGGKINIAESKFNENSSNRNGGAIYNEGEVNIRKSSIKKNKSDGGVIENINGDFKIFNCEFFSNESQGNIIFNQDSLEINYTDFKDNRSKSMLLNDGVKSKMSLVKGEINGNDVKDTLILNEGNSLTISETVFENNLIPNGDAIVNSSNLILTNPKINDDNQEIRNQGNLLLKRSSLDIKGKINGEGKIETDDHSNEDKFDFGYLDSLIHGSPDKEIVLDKDIKLENYEVDFYEGGIELDFDDLIINGNGKTIDARGKSRIFTISGKNITLKHITFKNGHSYKNYDNPLNNNGGAIRINANANLTITDCKFLDNLSEDYGGVIYYNGSGDLVLTASTMKGNTAENDGGAIFSSGEVKINKSKFINNSGNNGGAIAIVNSNDKASVTESIFNENAADSKGGAIWFHNSNIALADCTFNDNYATCGAAIYQEISKGSISNSTFKRNLSSYAYWHDGKLVTNKNHAIFIDTGSGLNDFNQDRDNIINCDFIDNNNNLYAQKHDLIKSRLDEHLALWKRNL

SEQ ID NO: 235 - protein, 120 aa, Methanobrevibacter ruminantium
MLIGLVICAGVFYFQFNYATPTYLIFNATEVNEGGSFTGVLNDAYGFPVVNKTITYHKPGYEMGTLVDVQTDDTGEFVIENAQYLPDAGEDNYYGAFTFAGDGKYQGCSFDGNITVIPKK

SEQ ID NO: 236 - protein, 253 aa, Methanobrevibacter ruminantium
MVLVAVVVIGSTAFLLNYDETVKYTTYNLSKTCMMDLPSGDNYENTTVNEAIRQINDTNRDLTVLFYNSEDNSTVARVEFEFTINDFKATATEQTVANRTVWYNEENGTYMAFLGNSVTHDNIIIITNDVEILEHLISSVKFIFLNEDGTVNSTSDMVNNQSINVTGGTASNGTDASASTATSNVSSSNSQSTGNDGYYWSGQDQDYIKEYTDSNGIQHIDRRNGPNEAYDPNTQRHYTDGVEDTAAYNQDFN

SEQ ID NO: 237 - protein, 315 aa, Methanobrevibacter ruminantium
MDKKTLAIIAIIVIALVAVGAYFATSGGSSDNVVRIGHLPSDHDTALFVAKEKKLFEDQGLTVELTQFNNGGDLMTAMASGDIDIGYAGITPVMSSISQGVPVKVVSGAQIEGSAIVANKNSGITTVADLKGKTVATPGEATIQNMLLTSALTQAGVSTDSVEFTTMKAAQMTDALKAGQVDAMIIWEPYSSIAVKNGDGVLIENSSEIIPGHPCCCVVAREDFIKDHRDSLDKVLKAHEEATKFTNENPAEAAKMLPEDIVPDQELQAKVIADTVFISGLDAEYKQKVMDFMALEVQLGLLKQPLTEEQIFADL

SEQ ID NO: 238 - protein, 1024 aa, Methanobrevibacter ruminantium
MNNKTLFIIGLFICLLFTIPMVSAADADSNLIDNSVIGTNINSQAITTSDASIDHSSNANAINTNINSDDIVSNNNNNNSIIDINDSDIESQKDGSSKNIIKSTNKNTNDSNNETEDNILVTDINLGKNNKNSNDKNILSANALTADGTGTTFGDLQYIIDQDTTGTITLDKNYKFESGTDDAYLDGITINKAITINGGNHTIDGDHLARIFNINTGSASDIVVLNSIHFINGMADGSGDNANGGAIYIGSPTTLNYITAINCTATGNGGAIYAHADGTNIAANYLYLYNNTAVNGGALYVYGNDYTVTVVDARYNSASGNGGAMYAYGNSFHLNKVNFINNTAYGEDSEGGAIFFAHNSDDSIVNNSYFANNSANRDGGAIVWDQGAHFGELYNSKFYNNTANHSSGAVRWSGENGTIDNCSFIDNKAYGTNLEPGDFDQGGDQILGGNGGAITWLGSVGIIRNSNFTDNYAEANGGGMFLIAFDINDPNSICNDTHIINCNFISNDAGLNGGALDWDGKAYNGSVSGSKFYNNTAARSGGAIFWKGNGGIITQSDFKYNSANGTHLVQPEGFLTPGGNGGAVIITGSDVNITYSNFTNNSARARGGAVYLQLNNNTMVLNSSFENNSAGTNGGALDFYTGAENGKVINSTFLNNTANRSGGGIYWNGEKGVINGSIFYDNKALNQGTYVNGSQITDGGDGGAIIWTGSHGTLENSTFKNNNATNRGGAIFLEKHNLEDPNDYCKNITVLNCTFEKNSAGTNGGAIDWFEGAENGRIINSTFTENYARRSGGAVFWNGVNGTISNSTFTLNEVGLEGADTGTGETIPTGDDDGGAIKWTGANGLIENSIFRENKALEGRGGAIYLENNENGTVNNCTFELNSAFTNGGAIDWHEGAKNGQLINSTLTNNTAGRSGGAVYWNGHNGTINGTNFTDNKALGTHHTEGQTEGGDGGAIIWTGSYGTIELSNFHNNSARWRGGAIFLQKNVHEGEEHCYNTTVKNSYFEENFAGSNGGAIDWSAGAM

SEQ ID NO: 239 - protein, 1024 aa, Methanobrevibacter ruminantium
MFKVEPASSNVTVEAVNITYLDNETITVTVPITNASGTVVIKINGTQKDERTVSGDNPTYNITVGGLAVGEYNVTVEYSNDPNYNSSNASTLFHVDKANIPDVNPDTGIVVVPTNITYNDDETITVTVDVPNATGNVTIRINGTDVELTKNITEDGSQSVTFNVPGLVVGDYNVTVEYTDDANYNDVNASALFKVEPAASNVTVVPTNITYLDNETITISVNVTNATGTVVVKINGTEVNTTTFTGEDKPTIVVTVPDLAVGEYNVTVEYTDDPNYNNSDASALFHVDKANIPDVNPDTGIVVVPTNITYNEDETITVTVDVPNATGNVTIKINGTDVELTKNITEDGSQSVTFNVPGLVVGDYNVTVEYTDDANYNDVNASALFKVEPAASNVAVVPTNITYLDNETITVTVDVPNATGMVTIKINGTGVELTKNITEDGSQTVTFNVPGLTAGEYNVTAVYHDDVNYNESNASALFNVKKSAPVNLTVTATNVTYGDNVTVTATVPNDATGNVTITIGDYTEKKEITPGSNTVEFTVPDLEVNNYVVYANYSSDSNYESGIVNAPFHVDKAPSHVEVDGIDINYTDLETITVTVSDNNATGFVTITINGTDIELTKEVSAGQAVFDVKDLVVGEYNVTAVYHSDRNYLNSTASDTFKVDKSDVKNMTISPVNITYGENETITVRITDNNITGNITISVNGTEYGPVELDNGVAVFNVPGLIVGDYEVTASYSGDSNYNPASSTETFTVDKEKPNVHVVSENIDYGKNETITVIVDGFNVTGNVTIKINGTEIATKEINDKGRAVFVVPGLQAGEYEVVAIYNGDDNHESSEGSDTFTVATVTPNMDVETEDIDYGDNETITVTLPKDAKGSVNITITDENGTVVYEGEAQLEDGKATVDVPGITPGPYNVTVKYPGDRNYNPTNKTVRFNVDKVVPDVDVDTVNIDYGDNETVTVTVNPVDGGVTPTGSVNVTVRDSDGKVVYEGNVDLVAGKATLDVPDLGAGDYTVDVRYGGDSNYDDST

SEQ ID NO: 240 - protein, 81 aa, Methanobrevibacter ruminantium
MIKTDNKGQITVELLLLLSFTFISIIALTNIISDANEVNNSHGCSKKTEHSKELPQTDWQSIQRTPLTTIQRTRERKAYSI

SEQ ID NO: 241 - protein, 827 aa, Methanobrevibacter ruminantium
MLNRKALIFSLIVLFMLSISAVSASDNTFNEGTGLNEDIADLNDFSDLNSNFNNGLSSNAVHGLDDDSNNNLSSENMISSSDDEKQDDLEGSDSDSIKDNLNSNSIKDQNNSNSSTADKSNTKIQTKISAKDINTYYKEKSSLVLYLKDNKNQALSNKTIKLSLNGKTYAQLTDKLGKASFSLYGLKPNSYDAKIEFYGDDDYKKSVRTVKVNVKKVDISINTKDFSTYLNSNIFFSVKVLNKLTKSPVEGIRIQFNVYSSQKNYKNYYALSDKDGIATLKKNLKLGSYDVYTYVKDDGQKDYINYRNTKNKVSIKISAPGEMGCSSIYIHVNENESAVAFRRDSTYAADLYIVAQKWHGRNAVKQYKLTGTYFFHAIVTSDGWLVGTGGADNPTINKKIESLAGQMVSSNNIQNSKLNTIRKYERSLGIGHFAIVDPKGNYAIVWKSGYVKGKLKNGQYIDVPNSRGMFRKGSYKSFSKDTATAALRIAATDRFGVNRRDITVFHYKRSTKNYQTSAQVKAYAANDKGNLAGRRTGGKSDNIHYKKTYISRSKLPGTPNKKLLGTHSFGKIDTLIKTQTKVSAPALTANQNQTKYFKVTVRNKKTNKTLRGVKISLKVYTGSKFKSYAVTTNKSGVANFNTKALSAGTHNVTISQANHKYIVSGSSKIVIKTVKKNNTVNSTNSSVVNGSGVNGSSSSNASVNNASEPINNSTTDNSSENNGSAGNSSSSDSSVGNGTASDGYVGNGSSSDSSVGNGTASDGSMGNSSTSDGSAGNGSNFASVLDVSAAINSDSNVGNDSQSNSKTETKLSSMKTDILTSFIKLIN

SEQ ID NO: 242 - protein, 132 aa, Methanobrevibacter ruminantium
MDNKAIIGIVIALIVIVLACFAYVTFNGNAPISLNVTENITNNTDTSVDTTDNATLVSQDPNNDSEVKDIAKNVSESISEQNKAVADSGDTLHKQTFTVSENETGQNEGMEPGTYVMYYTENDGPIKVQKID

SEQ ID NO: 243 - protein, 61 aa, Methanobrevibacter ruminantium
MDSSDLNKNIGTNLENNFNTDSNNNLDSNLNSNFNSNLNSNIDNSTQELDLSTKNFKALSS

SEQ ID NO: 244 - protein, 1024 aa, Methanobrevibacter ruminantium
MDGSYSNLTNLNFYTNATSENSNYLTPIYINEASDLVIENNPIYIDYSDGCNYNLAGIYAFGASNNNIIGNNRISIYSRSLSNTSKHYIYGIDFSSYSSNAYSKDNAKGNDISSNTIDIISDYYANAITLSCAVDTTLESNSLHLKSDSFVYGMVAEYFDFGNGLNPSNNFNFTKNTIEASSNMVYAIQFFNVFDVNIKENTIKTNSNGSYGISAYESYNHDIGYNNLFVNGNDVSMIGTNFDAIGTGHSGIYYMRDSHDLSIHDNNVLSNYSLGGDYAIRFDASSSENINVFKNNLSSNNGKYLGNDAVNGNVTVSENNHYYGDNDLGTNDLRIFDIYVDLNGNDNKGDGSIGKPFKSISKALSYLKNLTNIYGSSASSSSTTKVKGIIHLGEGKYNGYGTNLRIYITGLDVEIFGSGYNKTIIDGVSSHWFFDISEDSSVSIKNLSLANGVYRYNDGGLIHNKGNLYLENCIFDNAKMSPSSAIIYNDGILNLKNNLMNMTANGYHIYNNGFIDGLYLNFIGDSLSEDERLLNTDSLSFILTAYVHDDNGNPITGGYIRFFIEGKEILVNSSLIEGLAKLYTFSSLNGIIKISGYYSNAYTNLFVNIGKVNSSIISDTIKVYVNYSANESKSDGSFEKPFKSINDALDALNTCIEPVTITVLDDETTEQIDDSRLNRNNVITIESINKTNISTNWTFKSDANIRLKGLIFDGYGLVKDNTYLTIDNCLFNNTPASAIVSTNGSLTLLNSNFTNNNVKDNHTFYTGFSTPVITTSLWDIQYDYDKGGAVDNSFSNLTILNCNFAFNEAYNGGAIFNNQSDLHISNSSFTSNLAFSGFYENPRAIDFSNAMDKDQDRNVASKGGAIFQYLGEEVVVTDTGFLNNTAGGYGGAFYSSGIYPYRNDSSSIIEGIPFIVYETEDGLMDNFGNYADNLLSPQDIYFINCNFDSNVAPIRGGAVYCINNSQTQYISCNFGNNLVYTYNMSQLFGGLNKNSHRKWIFEDELDQVYSIFFTAVNNGGAIHD

SEQ ID NO: 245 - protein, 1024 aa, Methanobrevibacter ruminantium
  MOD_RES (45)..(73): Any amino acid
MSYFNKGHIWNILLICLLIGTLAMMGSASASSANLDDFSNLACDXXXXXXXXXXXXXXXXXXXXXXXXXXXXXNSYNDLSVGFESDANSYNDFSTYFESDSNSYDISDSLVNSNSDRLVNSNGLIEFNISAPNDIQLNDKAPIKNSLKEYDERVFYVSLDGNDFNNGLSQENSFKSLNKALENLHDANKTTIYVFEGTFLSENSYDLFFEGVGNSQMISIIGSGVNKTILDGEGLHRLFNVDNSINLTLRDLTFVNGFDFSSGGAIYNKGNLTLVNTCFYNNNVYSEDAYQHVSLLSGGAIENEGFLTIENSSFIKNSVGSVFNQYAYGGAICNHGNLTINNSIFNNNSLETYIDLNENSYFRKWNALQTGGAIASFSDGALISNTEFSNHSISILNKYPFVQKTFMTFSAGGAVYIEGNNHNFINCSFLSNDADNGGAVYFKGNNTCFDYCDFDNNSAFMGGAIMTIDYNLNEAWMPTLKNLTSNKYSNLNISNSNFSNNHFICTDFGIGYRISPGGAAGYFKIDNITIDNSSFTNNGVLENCTIFVSSRCGGAVFLYGQDSKVNNSSFVHNNVEVGGAIMNYGFDTNVSNSKFINNSACYSDGGAIFHSIGDLLIDNCDFDYNRAVKNGGSIQASYDYTNNYLFEQKSLYNNSRFKNSAAEYGGAIFDMGNAVLYNDLEFINNSASYGGAIYNQGFSNTFRNSTFVNNSAFSEDYSNGGAIYNYGSNALYESSIFINNSADMEGGAISNFGESCVVQNNTFNLNKAFKGGSVYLSGQGGRFQDNNVFSSFAIYGGGLYNSNINLICLSNSFNNCSANVSGGAIYNLVSTLELYSNSMNDCKAKLSGLGSGNYVFTCANISYLVISFANNGSFNIVDNKGVLLVANISDNMGNPITGGNFTFILFNQTNQDIDLIGSSGSSSSNSSNPSNLESSIIGVCDVVEGQAFLRYDTYLELGSRYTISGTYSYAAEPVLTQVANLNSVLSTRMYFSSNITDDMVNFGEGFNYEIILLDSNDNYIPNAE

SEQ ID NO: 246 - protein, 1024 aa, Methanobrevibacter ruminantium
MKNKAMFLISALLIAVILSLSAVSAADDAIAADIDDIDDSIEVSSVDLSADTEDISYTDVSFNTSKDKNTLSSNIVEEGDGSWYVDSKVETTGDGSQSSPYKTIKEAFDASGGNGTIYLASGVYNTTNDRSFSLALDSGNNLSIIGAGSDETLIDLLSLSNNFINVRNGNNFYLSNVKLIRSGTTAISGANITIEDSVFANSYYYGGAPILSLGGGDNTIRNCVFVNNSAGSWYGSGVAILNGNANVLFDNCLFKNNTNTNGGSVFYTTSSNIKLTLNNCNVTECPVAFYASYFGNVVFNNSYFYNNDVTRLNNRYCAVFYSTDPGNLTIDYCKFENNTGVDSASIISAYSSNRPLNLTVTNSEFIDNKMGKNSYGYYTVFNNIYMGSWGGNLYLKNNTGSFGNLSFVSISSANINSEINLIVLDNTTYDINAIEINVIGTLTDDMGNPINMSGFDLYFNDTLVGSQLTFDSGVNNYTFKEALSGSYLVKYVYNSTANFTNFNQKTSVMNISPLENIDVYVATDGSDETGDGTEANPYATVEKALDVASTALNANVYIKAGTYKYYRYRAIDTANGILNIIGYDGDVTIDMNNETAFCNVSNRSNVFISNVDFVNGYSQYLVDNYGIINSFGNLILSECKFSDNNGYYYIISGQSTIDSCTFENNKFQQQNSARILFNPAYVNNVTFYNITAIGFSANSLNQKYDLTIENCKFYDNARILISNGNVTIRSSEFANLSNQRALETQGVVVLSIDDCTFKDSDQSVIYLYDYASTTIANISNSKFINITHENPVYVGNGQEIYLENNEVSDLAAPYVYIRSGYVASPITILVLNNETIEQESYGATLKAKVLDDSENAISLNSFVFDFNDEQINGKLVYDEMVAKSMGIYDGTYLVSASSTNLLNPILKTGVLIITPLMNKELYVSTGGSDETGDGTEVNPYATLKKAMDEAVAFNNTIHVAEGVYAIDTALEIDTNTAIVNIVGSGENTVFDMNNEINFINTISANSIIELKDLTLANAKSPANA

SEQ ID NO: 247 - protein, 137 aa, Methanobrevibacter ruminantium
MKFNKSLIAIFVILIVAFSSISVIAAEDAEDDNPYHNGAVMNEQEPGSGEDDDNPYHNGAVMNPQEPESEDDDNPYHHGALMNPQEPGSTDDSQAAGSSQADSSNKVALSKYPTGNPLVVLLMSLSIIGLGTLRVRK

SEQ ID NO: 248 - protein, 537 aa, Methanobrevibacter ruminantium
MDKKIIIGAVVALLVIIVGAAVLMGGGTTERGPGEIVVAAYSHGGEPEAGFDPIAGWNYYAEPLIQSTLLKMTPNGTYAKDLATDYEISDDYKTYTVDLRKDVKFTDGSDLTAEDVAFTYNAAKESGASLDLSALDKAEAQGDYKVKFTLNKSDSTFLDKMAYIGIVPSDSYNNESYGENPIGSGPYKFVQWDKGQQVILEKNPDYYGKQPEIEKITILFAQNEAAFNLAKNGEADIVAVPLEYGKEKLDGYTMYLQDTIDVRGVSLPSVPDTGELSPDDNYTIGNNVTCDIAIRKALNYGINRTALAEGALNGLGYPSYDGIAHQLPWANKEAAIEDGDVAYANKTLEEAGWVDSDGDGIREKNGTKASFKIYYSASAPERQALAVGAAEQAKQFGIEIEPVGAEWDEIYPNEFSQGVLWGYGSTDPSDMYGEYYSSSDFNPARVNNSAVDKHMDDAFAESREDSYKDWSAVSWDGSTGISPKGDANWLWLGEIKYGYFVNDRVDISNDTALLQPHGGDLFSNVYDWTMTNATAEK

SEQ ID NO: 249 - protein, 164 aa, Methanobrevibacter ruminantium
MEGDNMVNIKTVALAVIAIIVVLLAIFAVSNVVILAQDDTEGGIPGVDMAALWSLNGGFQWIYPGSSFDPEGRTLHNIYMLDDPYGEVKTIMQYTYNVDPHILVIINDQAAAHIFGDNILDTIRQHDWVEGHSRGDAVGMSITSVNPLPIIPDILMGNIKIMFI

SEQ ID NO: 250 - protein, 1024 aa, Methanobrevibacter ruminantium
MNKSKKTMIMLIMAILVLLTMASVSASELEDIQVTASNGTSDAVIASEANSAYPDNAIITSEKENGDENIIATDNGKIGYENDDKTIIATNGNGGNIGYEDDDNTLITSDKELNALDKGKYQSLSVGDYHSFEELQTILNQADGGETIELNYDYSLGAGGSTLKLTKGLTINGNNHTLYGVGLDRILYISSLNTQPIILNDIIFKDGGKKDSYTNLETNWGGAIYYNPTTEGGAIGGEPADFIINNCTFENNGAVNGGGAIFWNGSLKIIDSRFFNNEIELGSGGAVYANGNLTAIGCSFSNNRVRHGLIGMDMLTTTFTDEGYWAKVIQYYSFYSVDVIPPTGGAIFCNGTCKINDSSFDNNQAGEANEMGTGGGAIHSMNDITVCNSTFTNNKAYDQHGGAILCNRSGFIYNSTFRNNVANVGGAISCFYYLNAEGSTFSNNGGEIGTTWMDEHSFDFLIDNFIGSIPIIGDIYGALQNFLDLLGVESVDVLTGQYFSVGGALYTGLDCNVDKCTFERNHAAEGGGAIYSERKVTAKNSAFSSNKVFRGDSAVSELMSSQGKNRDGGAIHAENATTIRNSEFSGNSAPSKGGAVYCAHHLEMSDSSFLYNTAYQNGGALYADTIGTISNTKFSGNSVTKGSGDGGAVYIIAQSDARFESCEFSANTAESDGGAIYIANSNSLLRLNKCTFIQNIAHLDGGAFNCRGKTEIKNSVFKRNSVDGDGQTENSQGGAAFSKGDMSISDSSFEQNMAKHHGGAAYTDGKMTVKNSNFTVNSANNGGAIYASVMNDEVTNSIFKKNTGTNGDGGAIYINDKSWPKFDSCVFSDNKCVVKSSVENSQGGAIYVRNDDSELKVTNSNFTGNAAGQGGAIFSGKVNEITNSVFKKNGASKSGGAVYIEPNCNPKIRQSVFEENVGGDKGGAVYLNSKYSYLELTGCNFTKNTAKEGGGVYAQQMSAKVSSNRFISNKATDGKGGGIYVRNYHITETVKRYTTEFVDCTFTSNTCTDNGGGLCMDSTYSVLK

SEQ ID NO: 251 - protein, 184 aa, Methanobrevibacter ruminantium
MTTTAFDFKIEGRIGKYFYFQLLDEYGNPVAGKNVSIGFSGRIYNRTSNETGWAKLQINLKYSGYYTFAVNFGGDDEYAAAFDVAAINVTIQTPKLTTSSKTYKASAKTKKLTATFKSYKGTPIPSKKITFTINGKKYTAKTNKKGVATVKVSLSKKGTYKFTASFAGDRTYKKVTKSAKLTIK

SEQ ID NO: 252 - protein, 121 aa, Methanobrevibacter ruminantium
MNNTTKILIGVLMGLLIVGAAVMFVSATAINDVSDGNSFMGQVQNTANHVKNVASNDIKSGSNIIGGGSEFNSQEGNGYFYQINYTDGNFRQYDTKTGKLIGSGFNEDQSILGNDDGFNLE

SEQ ID NO: 253 - protein, 398 aa, Methanobrevibacter ruminantium
MGSKNFQYLDELIHSSANEIILDSDIVLDFDEESEYDDGIKLDVDDLTIDGNGHVIDAKDGLCRLKNHAKNITFKNLCFKNFKSKFPISNQSGDLIFENCRFIHNQGTIYNYFGNIWLKNCCFYRNYLSRSSSGYSVCIYNAKDSKAFVSDSHFYQNEVNYPHYGLILNDGLIEVKNSIFHENKGEDCEICVIFNRKGELLVDNCKFKDNKNVYCSYDFAELIVSILNEAGKVSLSNSTFENENRILGSIKNMGICRIIDCKFKDSLIYNSQWYSSVSRPDELDFGPYLEVEDSSFANKYDEGVIANSGLCKIASCNIDGRSYLNNDDVLFIDEKDFNLLKDNIINSGEIVFDYDRDVPIYESFKGHGKSNGTNSNLEDDLDNDKSDDGYPPLGALFR

SEQ ID NO: 254 - protein, 168 aa, Methanobrevibacter ruminantium
METENLIIVILLVLIAMAGIFCAFLYTFGTGGNDLAPVEPNLTANQTNVTNMTNDTANATTVDAPLNNGAYGSSSIDSSSSNGLSGSNSYNGGSNTYNGGSNTNNGGSNTNNGGSSSSDSGNGGSVAPDSGNGGSSDSGNGGSVAPDSGGGGSSSGGSEPAASGESSN

SEQ ID NO: 255 - protein, 157 aa, Methanobrevibacter ruminantium
MFLVILLFAFIVIGGSYSVFAIVSNGGGNNSLSWDNITIAGPSGNVSDDGNNSDDGLLGIFNSGDSSDSSSSNSNTGSSSSQSSSSPARSSSSSSSSSSQSSSSQSSSSQSSSSSSSSSSSSSQSSSGSSYDSGSGGSVVESGGHYYDVNSGDELDW

SEQ ID NO: 256 - protein, 993 aa, Methanobrevibacter ruminantium
MALLILAMSCVSASNASDNLDDLTISDSNSLDLVSTSNSDILSSDSGVSSDDSSNDASGDVLGSDVSSNESNNQSQSTLDSNNQSQSGLDSDNSTLLDSQSNNQSNSESSDSSDSSETVIKNATSISVSSKTVVRGNSLNITLKDNASTLLSNKTVTFTFNGKTYNKTTNAKGIASLTLTATPKKYLVKIAFVGDELYEASSKSVNVTLSKTPTSISNSGKSIVRGKLYKLTLKDAKGKALSGKKISISFNGKKYTKTTNSNGQVNLTINVNVGKTYKMTYKFAGDSNYLSSSGSVSIKVKMGTSIIGSGSSIVKGKSYTVTLKNANGAVLSNQKIAFTLSGKTYNRTTNAKGQASLKIGLSSGKTYNLTYKYAGNSYYGGSSGKVSLFVKTPTTMKNSGKTIVSGETYKVTLKDADGKSLANKKVSITFNNKTYAKTTNSNGQASLTIKGTFGRSYPLSYKFAGDSKYGPSSGSLCLRVKKATSLKGSASSIVQGKSYTVTLKDSNSTPLANQTIVFTLDTKKYNRTTNAKGQASLKIGLAAGKTYNLAYKYSGTSYYNGSSGSVKLKVKFPTSLTNSGKSVMNGTGYNIVLKDSKSNLVSNKTISIGFNGKTYDEITDANGTVTLLIDANVPKTYKMTYKFAGDSDYGASSGTVNLTVKFKNAFTISQIISASSSLKSYVLKNKKVPATVSVNGVSLNLTSFTYLMAKATISINSNKTSGSILLVPVDSNYTNNGSRINANLYKANYIDLAKKVISSAEANKLVPNSVSTNIGLVSHDLYSFGLAKALVFFNSDHYLPNYLILSSDDVGEKHSTVIPSNARGNASQFKAGLNEAETLTAAQIAKYLVASGHDATNSEIKALAAKLVSGKTSLWDKANAIFTFARDNITYSYYADSKKGAAGTLSSKSGNCCDHSNLIVSLCRAANITARFSHAQGCTFSSGLVAGHVWAQIYIDGVWYTADATSRRNSLGNIVNWNTNHYNTLKQYDHLSF

SEQ ID NO: 257 - protein, 170 aa, Methanobrevibacter ruminantium
MNNKYFLGIIIIIIAVLAVIFAFSLDYQTNYLNGSSNGSVNTNENSSFNQSNNGLQTNVQLTISAEQSFPMEKIAEEIKTHPAYEGYDEDTLKWLETFNGSIMFTSKDYFVVMDKNDAENLPTSFVNDAFIYDDFTCDIIEKRSLGKDLKDIIYVKNVKFENQRIVPMIF

SEQ ID NO: 258 - protein, 555 aa, Methanobrevibacter ruminantium
MLLNDKSELLKSLSILFLLIVLITSFNSVYANSDNFDSAKSSDLIFSDSNNVYIENIDCSDSILINVYSNKKDSNLGSYFVGSSSDSYLKDSNSDSAFVVSNSEDSYLEDSNLNHSKNYLSSQSLSASSKSKVILTTSNLSASYKTKNFTAKLTDLNKNPIAGAKLSFVILSKTYYRTTDKDGLASLMINLAPGKYNISTKFEGDSNYSSAVVKNSITISKKKLSISSSDLSKKYGDSNSFQVKITDNGNPISDIKVALKLSAKTYYRTSDKNGLVSLPINLIIGKYIINSSVYDNKFYYSNTNSNNIIVSSQNPYNLSVLKWGTKGNIKKNSVLMNNIPKSSLTNAIISACNNGTPLIQFGNGSGKKVFINAGVHGHELSSQAAAFKLINNIYNSKKKINGTVYIVPVLCPKMTEQNARYFNNVNLNSVANKNGTVSNKLVNLALSLKVDVLGDFHCTRPNGDPGKNVAMGTSSPMASSATLAKYISKTTGYSSLIYKKAGEEYPGAVEDVCNLKGITSVTCEALTPHGKIASGSVGKSYNMMIALLKYYGITI

SEQ ID NO: 259 - protein, 110 aa, Methanobrevibacter ruminantium
  MOD_RES (104)..(104): Any amino acid
MKKIILGTCILFLLISVAYAGTVDIFTAPSPLQPLGNSGFGDGQGHNIQIFEFTENLYKTWFENDTDYVVEKYEGNNGLYLYADDENDCGILEIVEKDGKKYIXKFPWDS

SEQ ID NO: 260 - protein, 225 aa, Methanobrevibacter ruminantium
MKINLKRVILGIILILICISSASIISAYSIDSMEIQGGCISTGSGLEDKTYATIYVGEEYTGADVLIQIYYSRDGSQLNPGNKVPKTVDSLGCIEVPSANAFKYYPDLAEINLYDSDGYLIDSRDVSLSIHSGEQTFGDFYGSSSSSSSYSSSSSSGSSSSSGDGSTTTYHSGTSNSYVGNSNTGKFHAPGCDSVDKMKPSNKVYFSSRDEAISRGYSPCGRCSP

SEQ ID NO: 261 - protein, 235 aa, Methanobrevibacter ruminantium
MSNEISQNTEGIFLVVPAYNEERTVSQIIECIAERGYNVVLVNDGSADSTLELATESKRKYPDKIFVVSHVINRGLGAALKTGMMVALNKGAKYIITFDADGQHEISDIPNVCKPLQDGEADAVIGSRPFEDMPLSKSFANLVMNALTFIFYGRNVKDSQSGLRAFTAEAAEKIDVVSTGYGVSSEFIKEISDKNLRLAEVTITTIYTPETQHKGTDAIVGLKILGKMVIDLFRI

SEQ ID NO: 262 - protein, 357 aa, Methanobrevibacter ruminantium
MLRGRNMGMKNLILSKSDQFNHYKDKANQLKKENKELKLKNEELEFKNNELSPELEEGISLIIPSYKGENHIQPLLESLEKQTISKDLFEVIFIVNGEMDSTIDILTDFAKSNPDMNIIISYTSEGGVSNARNIGIRIAKREYIGFLDDDDFISDNYLKALYDHIAPNRVVLSNFIDIDEETGEEIGSRLVPYSMNREGIFNDVVVKLTNLSIITTAKIIPALAVKGTDFNPNLNNGVDVSYYARLYPKNHFEFYFVSKEEGAVYYRIRRSGSISRQETSYQFNVLDRLKVIDDINESYKQVDKSDELYVHFLKILFDAQTYFIGLYLDEYPQDREKVIEEVRKHNFEYFSYEKLEG

SEQ ID NO: 263 - protein, 397 aa, Methanobrevibacter ruminantium
MKILVVQESDWLKRNPHQQHHLMDRMVLRGHEVKVIDYPIDWPKEDSKGLIFHREVHENVSKVKPEADIEVIRPSFIKEPGLNYASLYFTHKKEIKKQIDEFKPDIIMSLGLLNAYTGSKLAKQHGIPFVYYLIDVLYALIPEKAFQSFGKKVNMKAIENSDLVITINQKLKELAMELGSKPETTILIDAGIDLNDFDPQLDDSNIRNMYNISEDDTVLFFMGWIYEFAGMKELAMELGKNKEKYPHMKILIVGDGDAYDRMVEIKEEYDLGDQLILTGKQPYERIPEFLASADFCLLPAYIDEEIMQDIVPIKLYEYLAMEKVVIASELPGISKEFGYGNGIEYVQKAEEVLETAQRILDEGRYEEISKKGREYVKSNDWEAITDKFENALEELIK

SEQ ID NO: 264 - protein, 331 aa, Methanobrevibacter ruminantium
MSKYNEYQDKTILVTGGAGCVGSNLTRKLAELGAEKVIILDNMSSAYEWNVPTNENVELIQGDILDDEELKRVFKMKPDYVFHLAAHFANQNSVDNPETDLMVNGIGILKVLQYAQLTGVERFVYSSSGCGVYGLDSKMPFEEHDISISLHTPYQVTKLLGELYTNYFHNLYDMPIVNARFFNVFGPGEVPGKYRNVIPNFFYWSMTKQALPITGDGTETRDWTFVGDIVNGLLSMGVEEEAIGEAINLGSGKDHRVIDMANKVNQLTGNEEGIAYVARRNWDAKTKLLSSIDKAKDILGYKPTVSFDDGLERVYGWFTDNWEDIERDAEF

SEQ ID NO: 265 - protein, 311 aa, Methanobrevibacter ruminantium
MKDKNVVVTGGLGFIGSHIVDALIDDNKVTIIDNLSSGKMENLNNPNHENLTIIKEDLMDADLEKILKDKDYVFHLAALASVPGSVAEPLRYNQNNIDASLKLFIACKNNNIKKVIFSSSSAVYGENPNMPLKESENFLPCSPYAAQKASCELYLKSFHESYGLDYVALRYFNVFGPRQDENSPYAAVIPKFISAILNGESPVIYGDGEQSRDFIYVKEIAKANILSAESDYNGVINVALGKSMTINRLFEIISDVLESDIDVKYLDERPGDIKHSLADISNLDKISFKPDEDKFEEQLRETVKWFISQME

SEQ ID NO: 266 - protein, 226 aa, Methanobrevibacter ruminantium
MASIVAIIPAYNEEEALADVIAKTSKYVDRVIIVNDGSADRTADVAIEAGAELINHPTNLGKGEALKSGFEAITDDSIIVTIDGDGQHNPDEIPIILKPIIEDGVDLVNGSRYLYGHEENTPAYRRVGQRVLDIATNISAGIKVTDSQSGFRAFSPKARNCFRFKDTGFGIESEMLVDAAEAGLKIVEVPITVRYDVDGSTKDPVTHGVGVLLKIMKDKAVRTFKK

SEQ ID NO: 267 - protein, 323 aa, Methanobrevibacter ruminantium
METQRIMVTGGSGFIGTNLVNELRSRGHEVLSVDLLHHEDEADLYSDSYSDYVRGDIRNYRQMERIFDDNDKFDYVYNLAAEYGRWNGEGYYENLWETNVIGLKNMIRLQEKLGFRMISFSSAEVYGDYEGIMSEDVMENRPIKDTYQMNDYAISKWAGELMCMNSATMFGTETVRVRPVNCYGPHEAYSPYKGFIPIFIYKALHGLPYSVHKGHKRIIDYVEDTANTFANIVDNFIPGEVYNVGSKQEWEMTIEEYSDLVLEAVGIDDSLVTYTPAEDFTTKVKTIDFSKAIRDLKHDPKVSPKEGIKRTVEWMKWYYRIED

SEQ ID NO: 268 - protein, 180 aa, Methanobrevibacter ruminantium
MTNKSPEEEIEELKAQLSKYRKENRILKERCASYEDRIEHFAIERKELSRAITQFESLELELRQYDLEELIQNTRKLNHRIDILRRYLQTEREDNEKLNELINKLTKELDDANYEISRLTTEFHKLRVRKNQRTYFLENRLDIAYTKLAQLKYTLNEFEELGFWDRLRGKKPESYDDIDI

SEQ ID NO: 269 - protein, 281 aa, Methanobrevibacter ruminantium; identical to SEQ ID NO: 85

SEQ ID NO: 270 - protein, 324 aa, Methanobrevibacter ruminantium
MILITGGAGYIGSHINKLLNKSGYETIVLDNLSKGHKKAVKWGSLVNADLSDSDKLREIFQNNDIEAVMHFAAFSSVAESVEEPEKYFKNNFENTANLLRIMKEFRVRKFIFSSTAALYGIPKEIPISESAELKPINPYGESKLMVENLLKDESDFGGLKYVSLRYFNAAGADLDCEIGEDHNPESHLIPLVLDAAIGRRNSISIFGDDYDTPDGTCIRDYIHVQDLADAHLKALQYLEEPFNDSNIFNLGNGNGFSVKEVIDTCKKVTGIDFEVKVEGRRPGDPDILIADSKKAEEVLKWKPEYPDLEDIVESAWNWHKKLHG

SEQ ID NO: 271 - protein, 66 aa, Methanobrevibacter ruminantium
MTVSFLFVNGAASVLLNAIDKEKAVTKIYIMAVIFNVCLNLVLIPMFSYDGEAISTVLSVKYLLSF

SEQ ID NO: 272 - protein, 37 aa, Methanobrevibacter ruminantium
MIIIPLSIGIFFYARLIIDFIYSNQYSLASTLIQIIV

SEQ ID NO: 273 - protein, 475 aa, Methanobrevibacter ruminantium
MNQIKSIFKNTGWLSVSQVITSICAFLWTIIIARYLGVSDYGIVSFAVSFTGLMGIVMDLGISTYITREIAKHKDLVRKYFNNIFLFKLILAIILFILSGLILYVMGYSHLTIIVTLVFTIELIFMSMTTFLNGVFQAFEKVKYQAIGAILNSSFLLIGILITLGFDLGVISIAFAYTVAYSIYFSYMFLSYVKTFSRPHLELDTNFIREVIIKSIPFGLTNFFYSIYFSIDIVMLSYLAGDYATGLYKSAYNIINVFTTFFVVYQSVIFPVMSKFFKESQNLIKVSYELSVKYLLLIIIPISIGIFFYARPVVDLIYSNQYSLASTPVQILIWTVSFLFVNGAAAVLLNAIDKEKTVTKIYIIAAIFNVCLNLILIPRFSYDGAAIATVLSEILITIITLYHIFKTDYKPDLGLLKNVIKLIVCGIILFVALYYLNLSLWFAIPVGFIVYLISLFITKSIDDNDRYVIRELINR

SEQ ID NO: 274 - protein, 258 aa, Methanobrevibacter ruminantium
MLMSIICVYNDEEVLEKYLLESLKTQNEEYELILIDNRNHEFNSAASALNYGGKKAKGEILLFVHQDVEFYENNLKDIKYYFENCQNLGIAGVQGVSEENYGRITTNIVSGIPKSTVSDYSITDITETQTLDELLLIIPKEVFGKYQFDEETCYDWHLYGADYCLNIKQKGYSVVLFPITLYHVSEGGSMSLEYFKTLKKVLNKYKYDYNRIYTNCLLSHEPNNQLKLDILYYSEILHIRNPITNFLSNFNFLKKILK

SEQ ID NO: 275 - protein, 333 aa, Methanobrevibacter ruminantium
MQTVGMILCGGFGKRLRPVTEKVPKPLVEIKEDYAILDKQLFDFKNAGINEVYLLAGFLHEKIQERYGDEYKGIKINYVIEDEPLGTLNAIRLGMEALGEDKQVVIRNGDIVADINLKKMIEYGERSDYFVTMFVTKMTSPYGIVDISGDKITAFKEKPLLDYYINGGIYFTKGLLDFGEFKTGDIEKTLFPVLAKENKLGYYREDDLFWMAIDTSKELESVQKEYENKTDKPWGYEKVLIYTDKYLTKELYLKEGFQTSFHYHNDKDETMYIMSGAGYIEFEDRKEYFGKNDSIRIKPGVVHSIIATENTTLHEVSTPFLDDTIRVKDYYTR

SEQ ID NO: 276 - protein, 335 aa, Methanobrevibacter ruminantium
MSEKKKIKVKFVDFQDSLKENDNFFIDSLKKNFDVEVSDDPDYLFFGAYGYKHLDYDCIRIMWTIENYVPDFNICDYALAYDIIEFGDRYLRFPFFLNRPEIENVRKTIERKPIDTSVKTDFCSFVVSNEWGDDYRIRLFHELSKYKKVDSGGRSLNNIGGPIGMGLDKKFEFDVTHKFSFALENAQNRGYTTEKIFDAFAAGCIPIYWGDPNIEEEFNPKSFINCNDLTVEEAVEKIKEVDQNDELYHAMLNEPTFLGDLDKYLQDFDDFLFNICNQPLEKAYRRDRIMKGKTQEHQYKLINRFYYKPYFFLIKVAQKLHIEFIGRKIYHFIRD

SEQ ID NO: 277 - protein, 266 aa, Methanobrevibacter ruminantium
MSSQNIQIYVVSHSEEDIKNIDSNDIYTPLFVGRAGKDNLGFVSDDTGDNISNKNSSYCELTGLYWMWKNSPADIIGLVHYRRYFANWRLGKRLEREDIEKIFSEYDIILPKKTTALLGSVYEDYDHWNYAKDLDLCEEVIGEQCPEYLDSYKRVVEGKDLYYYNMFIAPKEVIAPYCDWVFPILAEVEKRVDMTGYDDYQKRIYGFLTERLFDVWMDKQNLRVKECELKVNGLRLNVHMWIVKRKIVRWAYVHIYMGLLHKDMRR

SEQ ID NO: 278 - protein, 339 aa, Methanobrevibacter ruminantium
MPCNRKRESHIGGNVYTEEKHNINVHKYGAHIFHTNNKEVWNYINQFAEFNRYTNSPVANYKGELYNLPFNMNTFYQMWGVKTPEEAKAKIKQQKAEANIDEPQNLEEQAISLIGRDIYEKLVKGYTEKQWGRDCTDLPSFIIKRLPVRFTFDNNYFNDLYQGIPMGGYTKIIEKMLDGIDVELNTDFLEDKDKWMAMADRVLFTGMIDEYYDYCFGELEYRGLDFEFETLDMENYQGNAVINYTDRETPYTRIIEHKHFENAVSDKTVITREYPKAWEKGQEAYYPMNDERNTELFNRYNDLADKEGNVIFGGRLGMYRYFDMWQVIDEALKLVKSLE

SEQ ID NO: 279 - protein, 101 aa, Methanobrevibacter ruminantium
MRLEVVDKSVTKNINFRLVYDSIKAYRLSSELCDNFNIKNKDLFLNPYLLNWISLWLSRKNTKEENKIFLEEFDKLDKTKKYGLKYKLILKTTKLLLKIKS

SEQ ID NO: 280 - protein, 368 aa, Methanobrevibacter ruminantium
MKIAMVGQFPPHIGGVGVHIHSLAKQLIREGHEVYVITYPHKDIKDIDGIHVIGTKGINIPGLRGLMFGINAKKELKKLINEENIDIIHGHYLFPAGWASVKAGKSTNTKTYVTAHGSDIFEMYKKQKFMRPFIKKVLSDADIVLAVSNALKDEIIKIDVPGIKEKIKIHWNSVDIEKYKTTEENKDKFKKELVNEYNLDPNKPMILFVGNIIKRKNVNLLVEAKRLIKTDANLVIVGEGSELGKLKEKVKNDDKINDVYFTGARRDVEDIYPSCDLLVLPSFSESFGLVLIEALACGNAVIGSNIGGIKEIITEDVGLLINPNDSQDLANAIDKILQDEELLNKFKSNARNRAKDFSKTELPYDELK

SEQ ID NO: 281 - protein, 442 aa, Methanobrevibacter ruminantium
MKIAIVLGTRPEIIKMASVMDEIENRGHELLLIHTGQHYDKEMSENFFIDLKLPTPNYNIHVGSGSHGAQTGKMMEGIEEVLLDEKPDILLVQGDTNAVLAGALVASKLHIPVGHVEAGLRSFDETMPEEINRLAADICSKLYFVPTEESAINLAMEGISRKRIFITGNTVVDACFRNLEISKSRDKDQYDEGLQELDIDNMDNILTLTMHRAETVDDKERLTNIIEALEELSDMNIIFPIHPRTKKTMENFNLFDRLNDLPHVHIIKPVGYLDFLLLISKSTIILTDSGGLQEEAITLDVPALTLRYNTERPETVTAGGNILVGSDKEVILENARKILDDEDFANRMKSAKNPYGMGNAAELMIKIIEESDKNDTLKMVAPDEVMASFTRHMKAVDEDITVVDFEEKNNSLIKIAFQGEDIKYPYDELNLNGLTIIYEDYS

SEQ ID NO: 282 - protein, 574 aa, Methanobrevibacter ruminantium
MYKDNKILVVIPARGGSKGIPRKNIRFLGKKPLIAHTIEMGKASKYVDELVVTTDDEEIKFISEKFGAETIKRDGKLAEDSIPLDPVIYDAAIQKEGKSNEKYDVVITVQPTSPLLKTKTLDLAIEKLLNPDNENKDYDTIISVVDDRHLSWGYDEKEKKYFPLYKERVNRQYLPKAYKETGSIFATRREFVKEDSRLGENIGLIEVSKQESIDIDNYEDWWVAERILNKKKILIKADASHEIGTGHIYRGLSIASKLVNHEVIFLLDEAQELGIEIVKNNNYPFITHNSNKGKGKEADEKAKEEIIEKIVEYDPDIIINDILNTNSKYTKTLRDNGFFIVNFEDVGGGVKYAHLVFDALYEHKIPLKNLYSGHRYYILKDEFYYQSFKKIDKEVNRILLTFGGTDPNNLTEKTLEAILESKYQNEIEIILGLGYSKKEEIQEKYKDNERISIYENVKNMSEHMHNADLIFTSAGRTMYEIASLGVPCICLCQNERELSHIFGNIEHGFINLGLGSRVSKEDLIRTLENTINDYELRIEMNKRMGNVDLKHGFDNIRKLIKKEYKNWKAEQLNK

SEQ ID NO: 283 - protein, 279 aa, Methanobrevibacter ruminantium
MESKDITNIEEIIPSNDVYPLVNLLFQSKLFKSKEINTNSLAISCLDLIDKNRIKITFNEEIESIKISKNPLLKTKGQLEKELELMKNIKFTINSKEMKKLDKRDQIILKMFKDINKNHEFDLKSMYDKILKQDIAIKFAKYFKDYSKSLERETKYSLENYKDLIKDGEFTFKGNEISNEWKEFKSSLKSDKSLYSQDAEIIDKYLIYGRCLEIEKDVLKNIEKANPDYDSELYRFLRHNGADLLKLIFDKALANSKIERKGDGSVPVGNSKYFVPGFG

SEQ ID NO: 284 - protein, 356 aa, Methanobrevibacter ruminantium
MTIFNEEPFLIAEIGVNYYDIAKKENISNMDAAKLMVKEAHDAGCNAVKFQSYKANTIASKNSPAYWDTNEEPTQSQYELFKKFDSFGEAEYREIADYCKEIGILFLSTPFDFDSIDYLDDFMDVYKISSSDLTNIPFIKKIANKGKDIIISTGASTLDEVKLAIETIENANDKYKKGEAGIGIMHCVLSYPTANEDANLLMIKNLKDLYPNYEIGYSDHTKPDENMLILTTAYLYGATILEKHYTLDKTLQGNDHYHGMDPDDIRKFNKNIELIKTINGQYDKIPLPCEGESRKQARRSIIAKEEIGEGTIITEDMLTYKRPGTGISPSEIDNVVGKKAKITIPEDELIQYDFLE

SEQ ID NO: 285 - protein, 508 aa, Methanobrevibacter ruminantium
MTFTVKEICQHIWSLEEKYELNHKEIQGCYPWQLIRMYLYYEITRKTNVFESAQQSSLSLADKVNTFLPFIKNSILSNPLSGKDTKDVLIFDHPRKVILNGEYQDIYSYFLKDILIKNNKSFETIESPYLNNHFRSSANKKENNVKYNDRILLGSFINKTKNRGKLPFTDEEKDFIETIKRELESAFKIEINLFNIIEDHILNFQYDYKKYIELLEKRKPKQVYLVVAYENKALVAACKKKNIEIIELQHGTISPYHLGYSYPKNTMLMNNTIKEIEYFPDKILSFGDYWQNSSSFPIESDKIISMGFPYFEDNSKTFMKMADEDKNKKQILFISQGVIGKYLSELAYELAKELNEKNKKNDLENSENNESDLENNNYTFIYKLHPGEYGTWRENYEYLNKANEFDNFKVIDKSEPPLYELFAKSNYQIGAFSTAIYEGLAFNCKTFIIDVPGVEYLDDLIDKNIVKKVKSSEELINFIEDEDNLDLKEYDKDYFFKNFDESIFDEIL

SEQ ID NO: 286 - protein, 438 aa, Methanobrevibacter ruminantium
MWAQVNTTIALVPNIANLGLPYTMVRFLSAEKDKEKIRDSFYPMISLTFISTVIICLLFLIFGHPIADALFNGSMQVLYITTAISFFACMNLMLITYFRTFQEMKRYSLFLVLQSYIGVFVSIYLTYAGYNIETVVLGLLTGYAAVFIMMAFLIVRHLGFSFGKWSNLKEQLAFALPTIPSNVSSWVVDSSDKYVIGILLGSVAVGCYSPGYALGSILLMFLSPFAVLLPTILPEHYEKGDMAEVDKYLSYSMKYYLLLTVPAAVGMSVLSKPLLYIITTPEIALGGYMVTPFVCLGAIFMGMYGITNNILILEKNTMILGKLWIIVAISNIVLNLILVPYLNIIGAAIATLLCYMLAFGVTAIASRKTMRLPFNRKELVKILIASAIMGAVVYMMNPSGIVNVLVAILVGVVVYFAIIFVLKAVTRKEIGIFKDLVK

SEQ ID NO: 287 - protein, 390 aa, Methanobrevibacter ruminantium
MNILHVAHFFYPCLSAGGVVNASYQIALNQVKDNNVHVYTSDSCKQRLKFEDGRYDVDVDGIKVDYFRNLSNRFKLATMLDTPLSAYFRIRKDIKNHDIIHIHEHRQTLAILVSHYARKNNIPYIVQAHGSVLPFFQKEGLKNIFDKAFGFKILHNASCVFALTEVEKEQYIKMGVSEDKIEIVPLGINIEEYENLPEPGKFRSRFNIADGDKLILFVGRIHEIKGLDLLIDAFNLLIKDSSSPIKLAIVGPDDGYLDTLNERIAENNLESQVIITGPLYKREKHEALVDCDLFVMPSKYESFTTSGLEAMACGKPLVLTKNNHIHDWVDGNVGISCDDDEISLKEAMKKLLFDDDLSETFSSNGKKLIKEKYNWDMINEQILSIYNRFI

SEQ ID NO: 288 - protein, 362 aa, Methanobrevibacter ruminantium
MAKKVLIIVTGRGLGGDAGIALNVYNALTKRGMECEIALDESAPGILFKKNNMEWNKVIIPQAGGHSATLKTTVNAATRSVKALFKTRSLIKEKKFDLVLGILGGGAIIGALAAKITRTPSVSLLITPLDTKICGKIGTPIILPENNLFLEPNIPDRMVKSFLPVNDNISLGDKKKALDKLNEHCSELKKKNPDAMEFDPSKQTIVFSSGSSLFEKTAQAIDQFSKYSDRFNLVLCGDPLEEEFYKYIDETKIINVGFIDWVNDLLHLADLAVLTNDGLMLHEAMVCNLPVVILKRVKYGRYHDMVSIFKGATIECDLEDLDEAIFDVVDNYDDYAKNTATYKEAILSVGDNIADIVEKSFK

SEQ ID NO: 289 - protein, 522 aa, Methanobrevibacter ruminantium
MSEESSSSKVAKGSAIILIGNVIFRVGGYIYRFLMASLLGPAAYGILGLTTPFQGIFQVLSAAGLPPAIAKYVSEYNALDEKDLARQTIFTSLKIMVFLGLFFGFIMVFVAAPIITNYYHKPEALLPLQAVGLITPFSVIVGGFRGAFQGVYKMEYILYTRAIEQIFMILMATALVLLGLSTLGAVLGSVLGFVASAISAVYIFKRYMGKYIPPANPDFKFPLKDELKLAKTLIFFSIPVTVAALAEMGIYSICTLLMGAFLPAAAIGYFTAADPIARLPLVVSNSLATTILPATSEAYALKDQVLLEKYVTAPYKYGMFFVIPMCVGIAIFARGIMGLVYFTNAAYMNGAVSLAILVVGMTFYSVYTISGSIVQGIGNPRIPMYILIIGCVITLGLGWYLIPLFGIEGGALATTISSFIMMVPMFLIQFRMTKTHAPYSFLIKVTVASLIMAIVSIIVPNNVYGLITGIVVCPIVYVIMVILLKTLSHEDVAEFRKYANKLGPIRKYANKLLDFIDKHSSD

SEQ ID NO: 290 - protein, 545 aa, Methanobrevibacter ruminantium
MVIPAFNEEATVAQVVTVARKLSYISEVIVVDDGSTDKTVEEAERAGATVISHKGNQGKGVAIKTGFKNSHGDIVAFIDADVSNFTPTKIDKIIKPILEGKTDITKTKFARESGRVTELTAKPLLSFFFPELNYEQPLSGQFAGKRSALNKIKFEKDYGVDVGIVLDADVHGISILEVDIGDIQHDMSSLADLNKMANEVVRTIIDRAVDYGRVTMMDTLGNYIRMAIMGLSLIILGLFMIFFVPFIPLVISVLVALVGIALTIAYIIKIVQRSIPILRKGDTSTALKSFVKMHFPVIVSGLILILMLSTFLSAATFNDGRISVELTSRNFVYSPSDDYHQTISVRGPYTIDSAIENETDMVRIPPDALSTLEMSANDTMIIDGEYYSVNTSREGEVDVFRLSKAVRHDLDLYPREVIPNSRLAEVFNGVIVNHNINFNNSSEVMEGYVQFSISPKATNATFFNLTLDNESLLSSVGNFKNDSYYTIAYDDDILCAFTGDDIKKGNVTFEYAGKDGMIVFEDRNNTSIRNFIDSDRDSFVKLYTL

SEQ ID NO: 291 - protein, 1024 aa, Methanobrevibacter ruminantium
MKTRISVIIPIYNVHEFLEDCIESVLAQTINHWDLVDDYQRNLQIILVDDGSTDDSGEIAKSYAAKYENVEYRYEENQGLGHARNYGCEFAEGDYIIFIDSDDIIPPKAYERMYRIALKNDSDLTIGSVWRFNSKLTWASNIHEIAFGGTKELTHIKESPELFYDTTAWNKLIKFSFWKEHGFQFPEGILYEDIPVTMPMHYLANNVSIVYENCYLWRVRDGISKSITQTTDDLKNVEDRLYVMGLVDKFFNENVKEEELHRVKNLKWIKNDLMIFINKLKSMDIDESQEIIDLLLDYIDRNIDPKYFDEINEIEKLKYEYLFERDFDRLLKLLNYEHVNFYTLNIHSKGSDVVIEGDKDVFKTSSFIVNDFIKEGKKAKYIQKVNLEEEALEVSGFVVIPGLEAKEFKDVEYSFYLVNSENRKKIALRHEQIYLGNINSYRLRFGKKFSYKAAGYTVFVPYELIEDNEDFLGENKIIVVFKQRGVTHNIFAGNAKKNVRSRSENRAVLIGKTYMSIGYDKNNEIIINVSKARHSYDRIEIEDDDLCIFGPYDGDVFLHYNKSFISPESNIPFAYDDGNQCYRLDLDNIRSTEGQILYDNGESLVYKDKELLCLYSSKGQCVISSLLDHNIKINKFKNFSLVSEISERNNEIDIVSRLHSLDLGDRQLKSATLYFFLDKNQSSYPIAEAKIIKDVSTTQDSHIGDNAYIDDKDSEDIDSSSLNGENTYELNFKFNMNNKIITENLYHGYFDLLIRYDFGDLVFSTPIHLLDDFKALLKKKVFHFTIYRGNAWTLRIRAKKKWNWWDGRPRIYTRAYRIFKHLPINKKRIMFESMWGAKYSCNPRYLYEYIDENHPDYECIWSLNDEHIPINGNGIRVRRWTLKYFYYLATSKYFVDNVNFNERYEKREPQRYVQTMHGTPLKTLGLDVPGDFPTKASEERFIERCSRWDYITVQSEYVEDIARSCFKFDKDFLRYGYPRTSMLYTMNNEEDINKIKERMNIPLDKKVILYAPTWRKKNKVEIML

SEQ ID NO: 292 - protein, 1024 aa, Methanobrevibacter ruminantium
MIIPIYNVYEFLEECLESVVNQTINDMELTDGYERNLQIILIDDGSTDSSPIIAKEYAQNYENIEYHHEVNQGLGHARNYGCEFAEGDYIIFLDSDDKLSPNAYEWMYKTAIRNDSDMTIGGFWRFNSKKYKISNINKIAFNGNKEKTHISESPELFYDTTAWNKLIKHSFWKKHNFQFPEGILYEDIPVTIPMHFLANNVSIVYENCYLWRIREGKSKSITQTTTEIKNLEDRLYVMGLVDKFFDENVDDERLRHVKTMKWLKTDLLIFIRKLRSMDKEQGYKIMSLIRDYIQNNIDADEFKYLNEYERLKYEYLMDDEIDKIVSILNFKAENIKETKVYQKNGHIMFNADKEVFKQSPFYIDQYIRERYNRKYIQDIEIRDDGFLIRGFMLIPGLDIKNFKDREHRFHLTNANSHKKIKIDSEDVETGNISSFNIRFGRGFSYDAAGYKIFIPFSKICDDEDFFGENRISVDFKLNGIYQSPFLSYEKKELCQNFFLGYAKKDIRQKTNMKAVIYKNTYFLIRYTLKDEIIIEALPLKNYFKEIRLDENVLKLDSDHIGNLYIYYEADSINEEEKIAFEYDNEDKSYQIDIRKLKKKPGKILCDGENSIYKSKELILLDSKYGQCLISTLNDYYLDIYYFDSLTQVLDIRQNRDRIDIDAKLYSNRFNETRSTYKADRIKTAKLYFKDDSSKENYILSDGMIDRQTGDIKFSIDFSNKEITKNLYEKIHDLYVEYAYDETSTEEEAIVNKEVDESEYDSVSKEEKENNKIEKTENEPVPVEGRNNKINEESRFSTELYLFKGDDKTISKSYYEYKVYHDLKGFLKLKVLKRWPVYEDTPGKRLKHSQISYKLFSKLPINKKRIMFESIWGGKYSCNPRYLYEYIDENYPHYECIWSFKDEHYPIKGNGKCVRRSSLKYLYYLATSKYLINNVNFKKHFIKRKGQVEIQTMHGTPLKTIGLDAPGEFPTKKSQKDYIKKNKNWDYLTVQSDYVAEISRTCFKYEKDFLKFGYPRTDILYTKNN

SEQ ID NO: 293 - protein, 696 aa, Methanobrevibacter ruminantium
MQDPKISVIIPIYNTEDYIEETLLSVINQTIFDEIEVIIVDDESTDNSKYIIEKYALDYSNIQVFHQKNEGQGISRNYGLSKSKGEYIHFLDSDDYLPPTAYETLYNMALKNESDIVIGNVLRFALYNVWEESLYKNAYNDFDEDIAIMSLNERPSILWDTLVTNKLFNREFLIRKNIRFPNKKISFQDIPFSLESYILADSISFSKEIFHYWRLRSNQSSVTQQDKSLKNIKDRLEILRIVQNLLEKYEVEEEIRNYEYSKWLNHDLKFFLKRFNYYPKEYHEELFEEVYGIVKIIPDALIDSLNSYKKVLFTMIRNKDYENFLLFAPLENELYKNPEIPSFLNDEYKSYFDFEKAMEEEELNIELLDFKNDNDNLYIDFDGYLNYLSPNDNYKIIAKLVDENDYENPLLVNHLENKQIAIPFYLLKDKKRAQIKVIYEFESFKKTAYLKNRHRKSIEREKFFIDLDLGKNSYLYLDIREKNIENYIDIIDISFNSKEFTIKAKSKKSIDKISMENIISFEKIAYPIYDLKYEENEDNNLKNEENGEYTFKFKIPYYDILKSAVKKWELNCDEYFNSIKLSETFEFFTETYKIKFVNTRNKILIENEIFNPIKMIYALNHENTDLKLNIKTLKGENSRLNKEIKKTNEKNEILNEENKKLIDKNKTLNKENKKLNKKIEEYKSRKVVKIVDSLKN

SEQ ID NO: 294 - protein, 238 aa, Methanobrevibacter ruminantium
MIGVILAAGMGTRLMPLTKDIPKALLKINETTLLERMIKNCINADISKFIVVVGYNKDKVIDLCPEIAEKYDIEIKTIENEKYDVTNTSVSTYLASKFIEENDLDDFILVNGDNVVDPEIITRLAVSQNTGMIIDNFKELNEESFKLIIDDESFNEDKTIANGKINSIGKGLDIPSSTGEFIGVSKVVSDDVAQFNRILEKLIEEDPQNYYDFAYKDLSLIKTIDFVLTNGLKMDRNR

SEQ ID NO: 295 - protein, 406 aa, Methanobrevibacter ruminantium
MAEEKRSFKKLIKDILYISAKRSARALYYIGSYIIPANEKIILFESSNGRNYTGNPKYIYEEIVSQGLDKEYKCVWSFMHPDKKIPGNAIQAKRSFFKFLYYTLRSGTWIFDSRHLYYLKKNKKTKYIQTWHGTPLKKLALDMDYIDMSGNQDIEAYHEEFRKNTSAWQYLISQNEYSSNIFRRAFDFKGEMLEIGYPRNDILVNKDNEKDIDEIKTRLNIPKDKKIILYAPTWRDNQFYTKGQYKFATEMDFDRLYEEFSDDYALIIKFHYLVKENMDWSKYNDFIIECDADWDIQELYLISDMMITDYSSVMFDYSILKRPMIFFAYDLDDYKNNLRDFYFDMVEDVPGPICQTNEELVDFIKNYSENAYKNTFGEKYEKWNDKFNQFDDGKASQKIINLIKER

SEQ ID NO: 296 - protein, 399 aa, Methanobrevibacter ruminantium
MSINKSKSNLSLKNKLKSLFSGNSNKSRYQSKLIRGDFDSLHDLNIAYVLKGFPTLSQTFVSNELRYLVEDGFNVVVFCYMDPADLVELDFDLEVIRFDESDDPTGKLEQLLLDYEIDIVHTHFVYPPCTEYTFPVCDRLGIPFTVFAHAVDIFKYDVDKINRVDEISKSPFCKGILTLSNYHKNHLIERGVDKDKIHITRQATDYEIEELELKERNVRNIVSISRFVEKKGIDVLIDVADILRDEDYEFSIYGFGGLEKAYQRQIDELNLDNISIKGRLDGPQEVKEVFDKADILASPCRIAENGDRDGIPTVIFEAMAYGVCVLTTEVSAIPEVIDDGRNGFIVPPDSPEIFADKIREIANLSPEERFEIAKQAQVDVQDTSSVDETMKTLFLTWSL

SEQ ID NO: 297 - protein, 331 aa, Methanobrevibacter ruminantium
MTKPKVSMILSAYNEERFIDKAICSLTNQSLKDIEIIIINDGSTDKTPEIIEKYAEEDPRITVINQSNIGLGASRNKGMAIAQGEYVGFLDGDDWYRLDALEIAYNEAKSKDTDITMYQMINYDDATGRIYENDWFNLNNLDESFDGIVFTPEKTKDFLFDLSVSSCQKIYRNDFLKSINASFPEGIYFEDMPFFFYVYLKAERISIIRHHFYYRRKHNASITHVVDANYLDTVEAGCELMRRFIDNGFYDDYKFDLIAYKINGPRMALMDITEDAKEPLFNLIKEDYEKIKNTEYYQDYLDNLGPKKKKFFLDVIKYDNYEEFKKNNPEY

SEQ ID NO: 298 - protein, 419 aa, Methanobrevibacter ruminantium
MKICIVGQGYIGLPTAALFAKSGCEVVGVDINKEIIEKLNQGIAHIEEPGISDSIKNAVDQGHYHASLTPEEADTFIITVPTPYLPEDLSCDLSYVISACNSILPVLKKGNVVIIESTIAPMSTDEVIKPIFENEGYVIGEDLYLAHCPERVLPGQIMEELVNNNRIVGGITEECTKKAADVYRTFVKGEIIETEAKTAELSKCMENTFRDVNIALANELAKICAEIGVNALDVIEMANKHPRVNIHSPGPGVGGHCLAIDPYFIYAKAPETAKIIKLARDTNNSMPGFVIENTGKILSKLDKDAEKISVFGVAYKGNTDDARESPAFEIIAGLKAAGYEVVIHDPHFDNPDYLDFDDAIKDSSMILILSDHNQFKDMDYDSIKRNMKTKLIFDTKNIIKSVPEDVTLVNYGNLYKFIH

SEQ ID NO: 299 - protein, 286 aa, Methanobrevibacter ruminantium
MRILITGAYGMLGSDLREVLKNHDLIATGSKDLDITDEERCIDFIAKERPEIVINAAAYTAVDDCETHYDDAYAVNALGPRNLAIACNKIDIPLVHISTDYVFDGTKRTPLIENDKLGPQSAYGKTKLAGEEFIQENTQKYFILRTAWLYGIHGGNFVKTMLDLAKEHDEITVVNDQIGSPTFSLDLAMAICEVLDSDKYGIYHLTNDGECSWYDFAKEIFRISDIDVKVIPVSTEEFPRPAPRPHYSVLSNVKWKSAGFVPMRDYKEALNQYISLYNFFVKIGKI

SEQ ID NO: 300 - protein, 290 aa, Methanobrevibacter ruminantium
MKGIVLAGGSGTRLYPITKAVSKQLLPLYDKPMIYYPISVLMLANIKDILIISTPRDLPMYKDLLGDGSNLGMSFSYAEQENPNGLAEAFIIGEDFIGDDNVALILGDNIFHGHRFTEILERARDLDDGAVIFGYFTNKPEAFGVVEFDNEWNVLSIEEKPEHPKSNYVVPGLYFYDNDVIEIAKSVKPSDRGELEITSVNEEYLNRGKLKVELLGRGMAWLDTGTHDGLLEAANFIETVQKRQSLYIACLEEIAYSKGYISKEELLKLAEPLKKTAYGDYLTKLAERKI

SEQ ID NO: 301 - protein, 192 aa, Methanobrevibacter ruminantium
MGKFNIIKSEIEGVFTVEPTVFEDERGYFMETYNENDFKAEGIDLTFVQDNQSKSSKGVLRGLHFQYTQPQGKLVRVIKGEVFDVGVDLRKDSPTYGKWMGEILSEENKKQLFIPKGFAHGFLVLSDEAEFVYKCTDFYKGDDEGGIQWNDPDIGIEWPLGDLKEEDLILSEKDKLLKPMKDTPTDFYMEDE

SEQ ID NO: 302 - protein, 335 aa, Methanobrevibacter ruminantium
MTKILVTGGAGFIGSNFIKYMLDKYPDYEIVNLDALTYCGNLENLEDIEDNPNYSFVKGNIMDEGLVDVVVSSVDYIVNFAAESHVDRSIEDPQIFIKSNIIGTQVLLDAAYKYQIKKFLQVSTDEVYGSLGPEGYFTETTPLQANSPYSASKAGADLMVRAYGETFDLPINITRCSNNYGPYQFPEKLIPLMISNALEDKELPIYGDGKNIRDWLHVYDHCSAIDLVLHKGKIGEVYNIGGHNEKQNIEIVKLILKELDKPESLIKFVKDRLGHDRRYAIDSTKITEELGWKPKYTFETGIVETIHWYLDNQDWMEKVKSGEYQEYYEKMYSKK

SEQ ID NO: 303 - protein, 327 aa, Methanobrevibacter ruminantium
MKVSVVTPNYNGLKFLNAYFETLAFQSRFIEEIIIIDNASTDASCDLIEEYINSPSYKIDIKLIKNDKNLGFAPAVNQGIRLAKSELIYSVNNDVELEFNTIETLIQSMERSIEEGKNPFSIQSKMIQYHNRSLIDDAGDEYNLLAYTKKLGDGSPIDNYNEKREIFSSCAGAALYRKSILEKIGLFDDNFFAYVEDIDLSFRAQINGYRNYLEPKSIIYHYGSATSGSRYNEFKIRLAARNNVWMIYKNFPIPLKIVNFIFIFLGFFIKYLFFLRKGFGSIYLGGVKEGLRERKGIEKTHFEWKNWKNYFKIEWKMIKNTFGYFKK

SEQ ID NO: 304 - protein, 298 aa, Methanobrevibacter ruminantium
MRNIDLSIIVVNYNTFKLTRDTIDSCLAEPTHYTYEIFLVDNKSTDDSLEKLQEYFKSETERGILKIIPNQSNDGFAKANNIAIEQAKGDFILLLNSDTLMKQSTIDKCMDYITDKGHDDIDALGCKVSLADGSLDKACKRSFPNPANSFYKLFHINVDSDKNDYNLDDLDDDGIYEIDCLVGAFMLVRRTTIDEVGLLDDAFFMYGEDIDWCYRIKQAGWKIVYFGQAEIIHYKGASSEDKNTKKRNPKIIYEFYRAMYVFYKKHYTKKYNFLVNIAVYIGIGVLLVFNLVRNAFRS

SEQ ID NO: 305 - protein, 466 aa, Methanobrevibacter ruminantium
MIKENQRILNAILVIIDIIVILISLGLAYFVRFKTTIFSVGGSLPFSDYFIFTIVCIIPTYILLYYFFGLYKPFRNQSSIFSGAEDIVKSDIMAFIILVAILFIINQPNFSRIMLLLLSLFGMILTIAERVLVVLVLRMMRTNNLNLKHMLIIGDNDLAFEFAHKINSKTYLGYNIAGFLGRKENIGKRFEGTKFIGSFDDLPRVLKTHKFDRVVIAIPLKYYYHLNEIVDACEEEGIKAEIIPDYYKYLPAKPSVDMLDDMPIINIRYVPLDDAFNKFKKIVSDYFVSIVAIIITSPIMILTAIAIKIESPGPIIFKQERIGYNGKPFMMYKFRSMKVQDDEEEKSQWTTKDDPRKTRIGTFIRKWSIDELPQFFNVLKRDMSVVGPRPERPYFVEEFKKTIPKYMVKHQVRPGLTGLAQVNGYRGNTSIKKRIEYDIRYVENWSLALDVKIMFWTVFRRNKNAY

SEQ ID NO: 306 - protein, 386 aa, Methanobrevibacter ruminantium
MGGFILVEISIVIPVYNVEKYLRECLDSAVNQTFKDIEIICINDGSTDSSLDILKEYQESDDRIIIFNQENQGPGAARNLGINKSKGKYVYFLDSDDYLELNALEKLYNICEEKSLDFVLFKLLNFNDKTGKTFQTKYYNMAFLNDRIGDNVFSYKDLYDCVFNLAVSPPAKLYKRELITDIDYPEGIIFEDNVFFLKTLLKAKRIYFLDEFLYNRRRRDDSLTSSGSDDYYDIIPSMNYLFDICRDLDDFELLKEGLYYKKFKELYIRFSKVNDVHKEEFFNLIREDCLKHKEEIDEDIANDKLRKRSKFIYESVLSSDDYKEFHYRIRLYDKNKEINDLKKENKSLKNENKKLKSSNKKLKKENKHFKSTKAYKVWKKYSKIKD

SEQ ID NO: 307 - protein, 407 aa, Methanobrevibacter ruminantium; identical to SEQ ID NO: 188

SEQ ID NO: 308 - protein, 336 aa, Methanobrevibacter ruminantium
MHEYEISIIIPTYNSSKTIERTIHSILTQDFKNYEMVFVDDASNDDTVSCIQETLADKKVNYQLIVNKNNKGPAYCRNRGVFASRGKYIVFVDSDDLIQFNHISSLHNYVKSDNFDSAFTKGIKINNQDELIDFKVDKYDGLIHLARKNKGIVRAKDLINLELLMKIPFSFVLLIYDKEIILNNSLEFNEDYRYGEDTDFALRYLANCGNVRVIDKYTYFYYQEEDSISRQVSLDRFESVKLFESLDSYFKEDDLREKLVHSRIPRFIFGNMNYFFYNGYNSEDVFKKMDVLDLFNKLRQFKVFEKRDWKFYLKVRLFLLNHRLYYKLWLRFKNNL

SEQ ID NO: 309 - protein, 70 aa, Methanobrevibacter ruminantium
MNDLKKLYVLLAILIVIYVGINFSYNGLDTINTLTHVNLDLGPSMDNANDANHIKIGSSSFTKLSKIFTW

SEQ ID NO: 310 - protein, 335 aa, Methanobrevibacter ruminantium
MTKILVTGGAGFIGSNFIKYMLDKYPDYEIVNLDALTYCGNLENLEDIEDNPNYSFVKGNIMDEGLVDVVVSSVDYIVNFAAESHVDRSIEDPQIFIKSNIIGTQVLLDAAYKYQIKKFLQVSTDEVYGSLGPEGYFTETTPLQANSPYSASKAGADLMVRAYGETFDLPINITRCSNNYGPYQFPEKLIPLMISNALEDKELPIYGDGKNIRDWLHVYDHCSAIDLVLHKGKIGEVYNIGGHNEKQNIEIVKLILKELNKPESLIKFVKDRLGHDRRYAIDSSKITEELGWKPKYTFETGIVETIHWYLDNQDWMEKVKSGEYQEYYEKMYSKK

SEQ ID NO: 311 - protein, 187 aa, Methanobrevibacter ruminantium
MGKFKIVKSEIEGVFTVEPTVFEDERGYFMETYNENDFKAEGIDLTFVQDNQSKSSKGVLRGLHFQYTQPQGKLVRVIKGEVFDVGVDLRKDSPTYGKWVGEILSEENKKQLFIPKGFAHGFLVLSDEAEFVYKCTDFYKGDDEGGIQWNDPEIGIKWPLGNLKEEDIILSEKDKLWKPMKETPTDF

SEQ ID NO: 312 - protein, 290 aa, Methanobrevibacter ruminantium
MKGIVLAGGSGTRLYPITKAVSKQLLPLYDKPMIYYPISVLMLAGIKEILIISTPRDLPMYKELLGDGENLGISFSYEAQENPNGLAEAFIIGEKFIGDDNVALILGDNVFHGHRFSEILKRAMNLEEGAVIFGYYTQNPESFGVVEFDDEWNVLSVEEKPKNPKSNYIIPGLYFYDNDVIEIAKNVKPSFRGEKEITSVNDEYLKRGKLKVELLGRGMAWLDTGTHDGLLEAANFIETIQKRQSVYVACLEEIAFINGYIPKEKLLELAEPLKKTNYGQYLIKLAKMKK

SEQ ID NO: 313 - protein, 493 aa, Methanobrevibacter ruminantium
MNRFWNDLILPLFYEFKPEVIVEIGCFKGENTKNILEYCYYTNSKLKVIDPNPDSSFDPISLKNKYGDKFEFLKELSLNGLNLIEDYDAVLIDGDHNWYTVYNELKLIEKRFDQNNFPLIIFHDVSWPYARRDLYYNPELIPEEFRHPYKNLAMFPDKNELGDIGLNPTFNNAVFENTPKNGVLTAIEDFLDETNLNLSFFCLNAFYGFGVLFPSQSCDEKTILQIFYDSDVIGLLEKTYLKLRFTQEHIIKNKNIEINNLKDMNNSLNKKNIDLTGINSNLEKELDKLNNTKTEIEKELDKLNNTNIDLKEKLIISTNNQKELEKLLDNLKDDKTYLENELKDLNNTKTEIEKELNKVTNDKTNLKIELNNINNTNIELEKIVDDLCNEKSSLKNKINDLEYANQRTLKTIENLNGDIYSKTYENDSLKEDNLLLTKTNKDFLEDIKNLNNLNYDLEQKILNLEEEKNSILSSKTWKFGAPFRKISNIFNKN

SEQ ID NO: 314 - protein, 506 aa, Methanobrevibacter ruminantium
MTYKVSIIIPVYNAAEFIIRDTLKSIENQTMDFEDIEVILVNDCSTDNTAKVINEYAKEHENIVPINLKENNGQPGIPRNIGITYASADYLMFLDQDDTFKKNACETLYNKISTENVDMVCGNHNIVSNGRSNICFNFDWAEEDEIKINKIDENPNFLTMGVAAWSKILRREFVLDNNLKFTEGVGEDIFFSIRALLLAEGIILLKNFIVVDYLVRGESLSHQVNAEYLDEFCEFYLNFFNYCEKNIKNDNLYHPLFNGRLNHVLSMLFFADLYFDDLSWVLIKIHELFKKVAEKPFVFEDTSYRIFFDTLIKDEYPFENSINIYSAIKSNRERKFDKGVKYLEQEAKLYIDNGNGFNEKDSIIANYKIYEFNEVEFNLENFKNIKRIRFDPITWNFINCVIHEIKTNNGDLLYEAINSINRRELYGLNKEEQSSNRNSKENIRYKSSDDSSAEGIADIFLTTDSQYLLYGDFNNLKSIKINFEVNLIDNNEVSKIVENLIENYDH

SEQ ID NO: 315 - protein, 567 aa, Methanobrevibacter ruminantium
MSIKNKFLSLFNSSSNNSDFENLNNYYKKVLEDIENEDISGYDRNLKYYNDLKDCELFSSEYYITNQGLELSEEYALAHYLNEGYKQSRNPSPEFNNDKYLRLYPDVRLASLNPLAHYVLYGEKEGRRLPLSEYEELENEIVSVKNLIYQNRVTDNLVLLRDKVSKGKKVNVVFVLPAMMFVYKDLYNYFDNDDMFNVQIVLVPHRLGNSQKITDVAKDKHYQIFSYLKEKQYNVIDGYDFEKNEGIDLVSTCNPDIIFYVLPYMRIFPKTMKISNLPSNILYAYIPYGEFVEDNLDDLFFNFGWNEIAWKIFCSTEEYLINSTEKSIVGSSNVVLAGSARMDSLINFEESDEDYKWIYSKEENKKRIIWAPHHTLARPGMDDSLSYSTFDENFEFFYNYAKDHPDIEWVIRPHPLLKEVLSNINTNMRVQGIADENFADDYFFKWESLPNARFHEEIDYFDLFATADAMITDCISFKAEYLFANKPGLILNKTGVELDGYQGEITDAWYNCDGSDFEKIEEFIEDVVVGGNDYLKEKREEIFNKNFNVNLGSASKVIFDYIKNELT

SEQ ID NO: 316 - protein, 1016 aa, Methanobrevibacter ruminantium
MGVVMKKNNFNKKITFVANYFWTSIKEGSKSNSYFNYDNYLKKYPDVKESGMNPFKHYLLHGIDEERSTNFDENINSYSLVENSDLFDYEYYCEKNNLKFDSYSKALMHYLEKGYKKGYNPSIKFNAEEYYEVRPDVKRADVNPLVHYLKYGKIEVTSMTENLNLKEYQLVKNSNLFDYNYYMEKNHLDLRNETEAIYHYLEIGYKKGYNPSNKFNGEIYFKKNPDIEESGWNPLVHYLKYGQKEERTDKCDKNLKEYSLVKESGLFDYQFYKDKYDLDLNSYKRGLIHYLEFGYKRGYKPSRNFDGEEYLKRYPEVKKAGFNPLVHYLKYGVNEERIGLRRISFKNFNKNYDVEAILENIDNDVTILLNVEDSNNLKECIENIKSTTKDYKIILIHENLDDEDLEYIKSNNDIELLRRSPHESFINALNNILDNAKNDIIFLKNNIRTFEKWIFKLTVAAYSDDRIGFVSPISNYSTVSLINIEEDEKSSEFISNISKRDYEESPLPNDSCVFIKKDVFKELKFDESSNEENWFATFIDRGLEKGWKSILDDSTYVYYQFNEVEPQQADEYDYSTPYVLENRPSVKFINSDAFNNSFQNIHEYADDNLEENIQEKTRKNILFAMHYGGGVEFTVKDIVNAIKNDYECYVLRAFKNKMKLYKVFNDYFISIKEFNIKYPWTPKMIHSDEYKQIYFYILINYNIDILEIDHLLLHTFDLQELAKKLDIPIILTLHDFYYICPSYFLLDENNKYCGGYCGDQPRNCSTRVTWIDLPANIVEWKNQWQEYMKELFGMCDYILTATDFTKDMFLEHYDSLKSDDITIIEHGRDLIRYDNNYTVPNIYQPIKILIPGVIGPHKGLDFIKELKGFDDDNRLEYHFIGQVDDELKSMGIYHGPYEREDFAKWVFKIKPSFIGIFSVCAETYSHTLTESICSGVPVLASNLGALKTRIESQGGGWLVNIDDAEETYEQILDISSKKEEYKFVTENLKDIRISSSEEMGSKYKEIYDKLTKKEDK

SEQ ID NO: 317 - protein, 266 aa, Methanobrevibacter ruminantium
MEFIKYKSQFEKMIDNKIIGMPELIDSNISFKGKNNILCCNNIKLENIDIDFNGNNSVIFLGSNLGVNSHLTIFNNSTLFLGKNNTCGSSISISVAENQNLIIGDNCIVESDVKIRTSDNYPIYNYENSRINHSNSVFIGDNVLLGESSFISRGVKIGSGSIISPCSFLPPLFKAFSNSYVLGNPGRILKEDVYFVNDSINDYTIEEIKNSSINENESGLFDFVEKETLSLDKIDNILKKFNSEDSLDFIQKLFLQNKHKNRFFIE

SEQ ID NO: 318 - protein, 441 aa, Methanobrevibacter ruminantium
MKKPKTKAQKESREKKPNNLKSDCMKKILYVLHSGVTGGTFLTNKDLMKNVEKEFDVYLLSAENKFLKLFSFSNNKLKLIRKYHRNYGINVETEETETNNISWSAKDFHNSWLSNIYFEILVNYNIDIVHIRHLINHSFDLPQVAEKLNIPIVLSLHDFYFLCPFYTLLDENYNYCAGECSHNKKNCYCPMDSLSDINSKEFISEWRVNVLKMFNYINVFVTTSFFVKDLFLSIYSNEDIINNNNFKVIEHGRDFPKLKKQMFEIPSSNKPIKILCPANHLNIMKGSQLIKRIKEEDNKNLIEFHFLGNCHDGIEEYGFSHGTFERDEFHKKVEEIKPSFVGIFSIWPETFCHTITEAWSCGIPVIGTNIGVIQDRILKNKGGWIVDRNNPKKAYEYMAEIFENKEEYLEIANNIKTMDLKDTKMMSIEYIQIYNNLLEIK

SEQ ID NO: 319 - protein, 668 aa, Methanobrevibacter ruminantium
MTKVSVIIPIYNGEKYLKECLDSVCCQSLKDIQIICVNDGSTDKTLSILNGFASKDKRIKIISTENRGQGSARNTALKEAQGEYISFVDADDWISENALELLYFHAKSKDLDMLFFQMINYMDNSKNYVETELYNHLCFERNAIDEDTIFNFNDIKEFLFKIPVCPVSKLYKKEFLDSNDLYFPEGMFFEDNAFFYNSLFKSNCLGFLKKHLYYRRRHADSVTQTFDKRKFDIVKATNKVLDVFLENDQYLIFKKELINHTFSMLLEWFNKSPLELKDEFYRLIKRDFRGFNNLKEDFKNNLKEEYLLIFDISDKNKYYLDFLSEYKLSSADYDIFDKERYFHLNSQEYLEYKSNKSNNYKISVVIPIYNNETFIHRTLMSIENQSFGLENIEVIMVNDNSKDNTELVINEYSSKYENFKAIHIKEGTGSPGTPRNIGLYESTSDYVIFLDHDDYFEIDALEKLYNAINEEDCDFVYGTYASVDEDLPTKIIYPNELHGYFKNIYGNPRSIAFPPPSIWTKLFKRSFLIENRIIFPTILGEDAIFISKALFSADGIDYLWDDLICYHTLNKKSFTKNVSYDYLVQGFVSEEYLYNIYNDFESQSYELKENSTIPSEKSSENIEKMNLYKIRSEGILDFYLNQFYRSDLNDEDIYRIFPILSDFVSTRI

SEQ ID NO: 320 - protein, 256 aa, Methanobrevibacter ruminantium
MALIEKNELFLLEEIVKKNFAAKYKDSILGIFWSILKPLLIMILLTIIFSNLFGGSIENYPVYFLSGKIIFDFFNSATSVSMMSLKGNINILKRTAAPKHIFTLAGVVSEFLNFLITLIILIGVMIVTRSPFYILESMIAIIPIMSLIIMITGISLILAVLCVYFSDIQHLWGVITLMLMYASAIFYPMNIIPEPFHGIMILNPIFWVIGQFRILVLWGTIPSRMNMLNLVLLSVIILVFGIIVFKKFEKKITLKF

SEQ ID NO: 321 - protein, 74 aa, Methanobrevibacter ruminantium
MNQKRDELNSKQNINLDSENEISSSEINLKKRDPQNKSDLIAQQRMKAKRELIERYNMSESEAESTLQKHKKIR

SEQ ID NO: 322 - protein, 414 aa, Methanobrevibacter ruminantium
MQKKNKKITNEKEIEINSNKVRMDDKNCSLENSAGVSENKDKNDEAIKIQSQNSQIEGESEEIIPEHVLERQNPNKIDNSDYEINSVSDTLPVIEEGESKPIQNAEDEIVKKELVDSVSDVVPVVGEKEENNEPIIKKDDSSDVDDVLSSIIPEYHQKSSIEVNNVSLSFNIENDKIDNLKEYIIRTLKRTKEKKIKFHALNNITFKIYKGEKVGIIGYNGAGKSTLLNVITGIYEPDEGNVKTYGKISPLLSLGAGFDYNYSGRENIYLNGAVLGYDKKFLESKFDEIVEFSELQDFIDLPIKNYSSGMLAKLGFSIATIVEPDILIIDEVLGVGDVNFQKKSSNKIKSLMDGGTTVLLVSHSIVQIREICDKAIWIDKGELREFGEVNEVCDHYLKDAQNATKNQVKDIRFN

SEQ ID NO: 323 - protein, 817 aa, Methanobrevibacter ruminantium
MNYKISIIIPVYNVENYIEKSLNSIISQSIGIENLEVILVDDNSTDNSANIIKKYVSKYDNFKGIYCDIGSGFCGRPRNIGLSYATSEYIMYLDSDDWLEETACEVLYNTIINENADIVCGSQTRLDNEGNRKFYYHLWVTTLTDPNEDYNTRMKTTQEIIDDPNFKLVVTDLDKNPNILGHANVWGKIFKKDLITENELSFPEDIVAQDSVFLLNSFFVAEKIVFINDIIVHYNNLRCDDDDKSASYVKTTKNLFGRIKAYDLMDNISKKFSKEEFFYRYLLVGKLNYWFNSFLMDSNISTYEIKLLFKKYSHLFSNCYKFNTNLRKDIKNIFKEIDEGNYDIAASTVSKLQSKSFSASENKIKVSVIIPIYNNEKFLSKCLDSVINQTLNEIEIICIDDGSSDNSIEILNQYVLKDSRLKIISQENLGAATARNNGLKIAKGEYIAFLDSDDWLELNAFEKLYENITTNNSDLVLFNSIEHKENANLKERIHIKNDSIPDYNYYTFNYNYKKDLVMNGYLDIWSKMYRTSFLKENNIQFSNHQIFNDIQFHIKTMLNAKKISYCPEFLYNYLRINHPSLQNNLSLGNESFILLDIIDEIEDYLIDNEFYNELKSNFIRFKLTELESTLEKLENPYRNEFFKLIKNNFKKMQLTEYQRKELPPENYQFFNDVLTYDSFFEYALKNSEKERQKLSNALADSEKDRQKLSNDLENSGKERQKLSDALVDSEKEREKLSDALESSEKEREKLSDALESSEIERQKLSNALESSEKERQKLSNDLKNSEKEQELIKKEFTSSNSWKVTEPLRKIRRTIKK

SEQ ID NO: 324 - protein, 532 aa, Methanobrevibacter ruminantium
MDKNEIFTLWIPDNDDNNLSQLAHLSLKSFLLCDYDVILYTYDHIGNVPNGVCIRDANEILDKSKIFRYKGGFKTYSGFANLFRYKRLYEYGGTWLDLDLLLIKRLSDEDIIIGSQTQEDIYSNPNNALFRFPPKDPLIKTILDYSEKRGSDINHAETGTLLLKKLLASEFPEYNQYLKHFNYSNIVNWNDVGDYLESPEIFLKCLNTNEIYGFHLFNTFFKKFVEFPKDSFFTTLKDIILNSSTSEEYAFNLMKYNITTQKQYIGINEWDLSYLNIFKDAFSKNEFKYTILIDSQNLKKMEIYNIIRAIFSSYGLESEKDIQIIICGKSDIGHDKIKFKDNVIFLASDFQDMKYYLNDYIFGEHIFPINKPVIFKEEFFKNNNFTSDVEHHVLNNSNSILNVLNRESYKLCLLANIDVFNLDMDVLKTLNMRIKEVDNSLIYDYSFRDDDVLKLMKLVDQCDSKSFLNVKSELSNLNIKFLSQKTSYHYFSAYKNILNSNSYDEFILKEHNDKLQCLNAFYLNRINPRYDY

SEQ ID NO: 325 - protein, 332 aa, Methanobrevibacter ruminantium
MLDADEFIISDNGQNPREIIKKINENYYYLIKWITYVPTNNDDYNIKFIPKRITHVRDESLEQYYKVIVPKKVVNDFNVRVEMGNHNLKFDNFNRNELVKKDLNLKIAHFPLRSIEQCISKVSIGWPNIIAINLYNLSWGFHWKMLFDKIKEENDISLDDLEFFAKNYALVSTSDDILIKNQPINLDFCDKIEIRYDFEYNYLRNILENYAYFAEEIVSFKRKLKSVPILDDRFILKLASDYDVIEKSGLFDVNWYCKRYSPPRNIHPIIHYLLTYRENMNDPAGFFSTEYYFKTHVDVANSGMNPFVHYIKYGKKENRKIASSKSENFGVQ

SEQ ID NO: 326 - protein, 410 aa, Methanobrevibacter ruminantium; identical to SEQ ID NO: 189

SEQ ID NO: 327 - protein, 1024 aa, Methanobrevibacter ruminantium
MGFRFSVVMAAYNSGAYIQETLDSLINQSLDFKENIQVIIVNDASSDNTESVCQEYIKNYPNNIILINNRINCGPAHTRNVGLHYAEGEIINFLDSDDYISKKTFERVDSFFEDFVHVDMASIPIKFVGSKRGDHPLNYKYKGTGVINLLNNPDAIQLSSASAFFRSDILKASLFNHSRSRYDGSVSVVYNDNSPVSDSIPMIFNENLSVSEDALLINQMLLRNPLLGILSNCTYFYRKKATDNTSLISDSANHRSYFTSRVNNYMIRLINDSLDLYGKVPEFIQYVVMYDLQWIMEIRQVDHLLDLEDLTHLYDKLISILFYIGDKVIFNQRSIPSILKSHILLLKYFGWGYLDDKTFNFKQIDKKYYDEHGNLIPYIEKDQLSFIIQKLELNKIYLDIVDIKNIKSKINLNNNNNGTPDDDKKDDGKNSHDFYLSSQDDEDRQELYLSGMITSFFNSDFDIYAIVSEKDKSSSHILEKEIKVKKISYPQRDNLSLNFNYGYNQCFEVRIPLSEKTSRISFRMGFKSLNEVCNSLGIETLSEDSFDYINHHDLAFSGDLLIDYNHTSRLSQVSNYKISKDYLILDNGNHMIVRKRSLLTTIKYELVTFASILGEREEGWRTGILLRALYFILYPFYRNKRIWIFMDLPYTADDNGLQLFKSVRNMDKLKLEDYNKLLDLDESLLSRERHPYKYELFEGKDIGLVGLIKNVFSSIKNVFSRDSDDDENGKVKFIKGGSLGLDDKYDELEDNGDYSDYLNEHFGFADVNEDYLDNQDIQVEGSSFEDDIEHSSKFRRNVYGKAGFVKSFDAKVDAKYNDSLNSLENRFDKRVSNIKTRTRNADVREKVGLSRDRDDNFSKGFSPIDFIYGFDLSKFLSENSFVYLVNYILYRISKLLLRPRKIKRIDNRKIKKYFTLEQSTSHFNNVRHMENQYIASSNRDKLRKLLAREKQSNEYNALKKIGPVLAYKSLKHRIYALYAEVIVSSHPDNNLIYPFYGNFPHVAGLVKAKTVFLQHGVTKDDVSF

SEQ ID NO: 328 - protein, 338 aa, Methanobrevibacter ruminantium
MRYIADELKGRKTSDGKPYEFEFIPKDEFSLSNMKKLATSKYIFLTDNFFALAFMRFNKKTKLIQLWHGTGIFKKFGYDLLEDEQKKTMLKFSNKITNLMVSSHNVIDIYARNFAIDKSKVLPLGIPRNDYYSPEHLDEDYVRQLRGEFEQRYPNLRGKKIVLYAPTFREDPKYNAVFNYFDIEKFIDELGDDYILCIKLHPNYNKFADSANRIDLDELTDTYNIVNFTEYKDEQKLFLISNILITDYSSVMVEYTLLNRPIILFAYDLDNYLENERGFYFDYRKEVPGRIVKDTDELVRVIREKDFNLSNLKEFAEFQFDYFDAYSSKRILDYVLEE

SEQ ID NO: 329 - protein, 701 aa, Methanobrevibacter ruminantium
MKLSIIIPTYNEEEYLPKLIESIRSQEFTDYEVIVADADSNDNTREIAEAYGCIVVDGGLPAIGRNRGAAVAKGEILLFLDSDLELTEHYLENVIEEFEEEDLGIAITQMTPLSQKKRDIYLHNLANWFMIAVENIKPHGAGCYGIISRKELHDECGGFDENLTFGEDTDYIERVAEISQFKVLRNAKIGVSTRRLEEEGLYTLLKQYGKSTVNDFRGKRTSAEDLGYEFGHESSSKLESGVQESVPKLENGVQESVPKLESSADISSQIEDNSPSLEDEIDIESDHYPITALDSTDMERIAEKSKNRKQSSFKRRLNEFKDKEFETNELIEYEDESGHIKHEAVGLDSRKKIFYSICGEGMGHAIRSSVILEHLTKHHDVYIFSSERAYKFLSEKFDNVYEIGGFNTVYENNVVRTKKTFFKAMKANPTNLKEGYNVLYKECKKVKPNIIISDFENYSSMLSKLMNIPLISLDNIHMITQCDYDYPPHHKADMLTAKAVTKSYILRPKRHIITSFFFPPLKHPKMTALYPPVLRKEIMDLESESGDHVLVYQTAESSINLMDELKKLDEEFIVYGFNKDGTDENLTYRAFNEDKIYEDMRTAKAIIVNGGFTMISEAIYLKKPIYSTPAHKNFEQILNGFYVEKLGYGESHEDLDVKKIEKFLDNLDTYQNNLNKVEKWDNTAILEDLDLSIEMYAKKNY

SEQ ID NO: 330 - protein, 900 aa, Methanobrevibacter ruminantium
MEKQQVKTILKSVVIIAILLIIVFGLRAQSVDIGGVPNELKSHYVDENGLPYFSEMDSYFNYRMTENYMDHGYFGDTKVNGTGWDMHSYFPSGRAVGDYQPMIAYVTSFLYGIINMFQEMSLLEVAFWTGAIVSSLAVIPTYIFTRRITNDYGAIAASLIVVLGPNYISHTFAGFFDTDMFNITLPLFFILFFVEALKTDKLSYRIIFSLLAVASIALYSLSWTGYMFYVAVMVLVMIVFFVLCFYFNIEILEPFKNYGNKLEWLINQKELFATLIVLVVGLIGLLLAVGVGGIIEGITGLTGGFTLQAGAADVWPNVLISVAEMQIPNLVTGGLVGSFLANTGGVVNGVGGIVCLFGVLIVLYTFVQRLFRLNSVKVKGDTAKPHKSKRKATSVRTEQKRFSVSLKDIGSFGSTDEINKSKRHTVLYLSLFFVWIVSSAIAVTQGTRFIQVLVVPMGICAGIFVGYAVDYVKNNVDNDKVLLLIAVIASILIALPITQIAYGLDNAMTIGLVVLVILLAISAIVIYAKKSIKDSDVSIKKALVVVLITLALVSPTVCGAFQTTAATVPGSSDPMWFAMDYVKENSTNDTVIISWWDFGYLFQVASDHPTSFDGGSQTGDRAYWVGKSLTTSDYAQSKGILQMLATTGSNASMLLSEYTGSNVTAVHALDETLGKSRSEAQKILTSKYNLTNDQAKAVVKQSHPSNPNNVSFVLSSDMIGKAGWWSYFGSWNFDTLNSTNYQYYMANDYVPIKQNTQGNITILNESGIIYQAVVNRGKNGTNETTAQMETIWDNNRSKIDLNGTEYNPLKASNLICIENSYLTVNKTLNKDGNYTLYLLGSGDDYTAILMDNNLKDSVFTRLFLLGGIGQDTFELSNMQDGVSVWTLRDGSSNSDDAGSQ

SEQ ID NO: 331 - protein, 341 aa, Methanobrevibacter ruminantium
MSSLISIPTLPLIVIALICGILSFISTRLVMPWLIGKLEQAEIIGKDIHKSSRPIVAEMGGIGIIFGFIIGIFAGIILFPVLTFQLVVVLLVVLLVGIIGMVDDLIVLSSKEKLFLLFLAGIPLWWVAPPNVGLLYMIMIPIAVSITSNLTNMLAGLNGIESGLGVISMTSLTISCIILGKYDVAIISMTMLGTLLAFLYYNKYPAKVFPGDTGTLIIGATIAAIAFIGRVKLIAFIVLLPNIIDAALKFYSAGVMERQQHNPTQLNEDGKLVRPEQGFKSLIRLVLRKPVDEKTAVMMIWGIGIIFGILGIIVALLMPGVTHDQTFAQFIHLKDYFYYLG

SEQ ID NO: 332 - protein, 44 aa, Methanobrevibacter ruminantium
MKVEIMIIGILLLSNFLYHHEDGNPIVQYVAYIASLLVIILGFF

SEQ ID NO: 333 - protein, 452 aa, Methanobrevibacter ruminantium
MEKSVILLAAVVSFVTAFLANISVALPLIARELAMSNIIQNWVATIYLLPIAMLSIPLGKLTSKHGLNKSLLAGIILTIIGVIIACFSINSELLLLSRVIQGIGTALINVASMALIVSAVNPETRGQALGLNIAGVYIGLSSAPVIGGLVIYHLGWQSIFYIMLIPLIFSAYLSWSLKDEWTMYDGPIDITGSIIFSIGILLVIYGFTIVNTWLGIVLLIIGLLLLIAFAYFELRVNNPVFDVRLFKNSRFSSSNIASLISYTATFVITYILTYHFQYIMGFDSKFSGMLLIVTPVMMAILAPLSGRLSDRIDPQKLAAIGMGFVTVALTILCFLNESTPLYMILLAMFLQGIGYGLFSSPNTNAIMSSVPKEETSSASASLAAVRVIGQTLSLGMLTVIFAYIMGNVAIVPEYYPLLMESSRLSCIISAVLCVIAVVASLVGLRSDDEYET

SEQ ID NO: 334 - protein, 594 aa, Methanobrevibacter ruminantium
MNSKQKTLIILSLSLILLASIAAVSAVDYTLTNADMDYVVKSNGLLHVHEAITYDFDSSPNGVYRDIPLKSGQSIENLEVYVDGAYAEYQIIPKGSGERIKVYLYTDSSKSHKLSSDSVITVHYVYDMPKVVKIYNDIGELQYKVWGDEWDEDLENLQSTITFPDDEELQFWINPYFSNAKARWAEDHLKIHSDFVGDGKYVEARALIPLSEFDSNAEYAQHINKNGKDEIIKIQDDDKKSQEGFKSLFSILNKVLVVLCFIPGLIYLKFGREPKTTYDAIYEHEPPTDDPPAYVNGMIGSGLKDVGSLNQEAFQATIMDLINRGKMGVSSEEDTEFTKTTFLTIKDTSGLKRFEADVINILKRYELNGNISLSYMQDCLRGESEARYFQGRFESWKENFENEYFSEDSFSRLFDKKGNDYLNYFAFLLIILGIIAFVASIFFDFAVTGSTIFVGVLLVIVGVVCLMLPSGIAGKYTDEGKLYEEKWMKFKKYLQDYSLIKEHPPESIVIWNKYLVYATALGVADEVYKAMKMEVYSGSDDYYRTNDLYMFYYLGGHRFINDSFNTASSTISAADNSSVGGIGGGSGGGGGGAF

SEQ ID NO: 335 - protein, 596 aa, Methanobrevibacter ruminantium
MNNKQKTLAILILLAIVLTSISAASAVDYKITNADVHLDVEDNGILHVSENITYLFKSDGHGVYRVIPLKADEKMSYLTVDVDGSYFEYNIINRSGEKEVRVYLYKDKDLTDYGVSEGSTVTLKLDYYMENVVKLFRDTGLLEYKLWGEEWDQGVEHLNAKVTFPNDEEIEYWINDDSGKTESSFSGDTLYVKGSDIPKGDYVEARVLIPLGEFDFDADYALHYNHDASDEVKKQQEDFQKKQQYFNTIGNLLNVIYGILILTPLGIYLKYGREPKVSSDAIYEHEPPTDDSPAFVNAMMSGLSKDVGKVDKKGFQATIMDLINRDKLGMEIAYTNKKRPVSLLTVKSTDGLKDFEMELIDILRRYEQNGKINFLYMQQQLSNRNEAYHFNRAFNRWVSNFKVDYLPDDVLSRYFNTKGSDLIGKFKWIALVAGFTGIIGLLLTGSWIPLVLGLILIFVGVICFYLPSSIGGQYTKEGREYQQKWKRFEKYLKDFSLIKEHPPESVAIWNEYLVYATALGVADKVYKSMKMEVYDGLADGSNFSSNDLFVFYHIGGIRSLDNSFVTVNNIISADSSSSGGIGGIGGGSGGGGGGAF

SEQ ID NO: 336 - protein, 584 aa, Methanobrevibacter ruminantium
MNLKQKAIIMLILSILLMSAISASDYKGSYMDYVHMNVNENGLVHVNESFTYQMVSPESEISLPLYHGTNASIENIHIRVNDLLVAYDLKKGDTLDELVIHPKSSDYDYDSESTGTYLLDVEVEYDIENAVKVYNDVGAFTYQINKTDFNGVSLGMAHIRIKFPGTQEHEYFIIPKEGESSAQWDEDHFHMTNSQPAKATVIIPLDELDADAKYAQHIDSDGLEAIKNDSFDLKYSLIQIVNILIKIFVIIAFILPVAIYLKYGREPKVTLDSIYEHEPPTDDPPFFVNAIMGGTFRDVGLVDTKAFQATIMDLINRGKLSVETEINEKNKQRTYLVAKSTDGLADYESDLISILRRYEEDGRIDLKHMELSLYSKSEARYFRGRFNSWGHLLYSNYLTDDIKAEYFEDKGSKLFKFFAYGGLILSVILFLYCLMFNQMEPLPWVIALFILSSVLICIPSAFAGHYTKKGKIFKERWNNFKKYLKDFSMMEEYPPESVAVWNKYLVYATALGVADKVSNTMKINFYDGLNDETYRDNDVFVFCDGNGLDLIGDSFSAVSTTLDSDSGGSDGVGGGSGGGGGGAF

SEQ ID NO: 337 - protein, 418 aa, Methanobrevibacter ruminantium
MNITENQSDNDEKILTKSFCLIFGALLFTALVMYALMSTVTEYASSMGSTATIAGLVSGIYVFGGLCSRIYSANALEKKDWKTLALIFLSIHFLACILYFFVDNVELLILVRFIHGLGFGASANAIVTIASSILPKKRFGEAFGYFMLGTTIAVGLGPYISGFFYDIWGSFGSFLLATVFSFIALVCVFFLDIERYHPDEKINNEDILSDAESVGTESIDANPIKKQKEKRSFIEKIFEIDAIPVSLFTALTALGYVSILSFYRLYAVELDLVGPFSIFFLIYSVILVASRPIAGKIQDKNGDKIICVIGIVAQSIGLFLIAYAPSDITIYICAVCAALGFGTLNSACTTIVTRNCSIDRRPYAISTFFIFCDSTIGFGPALLGCFVSATSGYAPIYYISAFITLMALPICLYSLRNK

SEQ ID NO: 338 - protein, 489 aa, Methanobrevibacter ruminantium
MGEKAQWDSSLSFIFAMIGAAVGLGNIWRFSYVLYSNGGGSFFIPYFVAIAIMGIPFLILEYGVGFSFKDSFTNILKKIDGRLEIVAWILILFVFIVVIYYMVILSWDMVYLLTSFTFGWGVDTAAYFTNTVGGSADLAKGGIFLIPTTICVVLMWIVLWFISHRDVDKGIGKVSKVLIPSLFVIMGIIVFYSITLPGHMIGIDALLRPNWRMLLDVNIWLAAFAQIIFSLSMGQAIALTYASYLPESSRLTDNVLIVVASNSLFEIFTAFGVFSILGYMSLNSGMALNKLVTEGTGLVFIVFPMIFNVMGTVGRVLAPLLFLAILFAGITSALGFFEPMLSSASSKFNLSRKRTATILSIIGCAFSILLTTGISSYLVGVIDSFVNQFGILLLIGVQCIIFAWVYGIDHFIPVLNENGILKVGKIWKFIIKYLLPVVLFVIWAYGIFTLFTTAKTFEIMVDIIIIVAVLILSFILSHLNPRGSNEDNA

SEQ ID NO: 339 - protein, 255 aa, Methanobrevibacter ruminantium
MKENKEMNWKIKFAIIMFVLAVLIFLARYLICGDGEEIIAYLWKHIGFIPIDILIVALVLEEIMGRKEHEAILEKIDMLMGTFFSEIGNDLIAELSKANVNKANTDDLKAIKSWNDKDYDNKLKELKNNPVDFKANIAPEEREDFLNRIQSLLVENREFLVNLINNPNLLEKDEFSSLLLALLHLDEELARRGELTDIKDADFNHLNGDMKRVYSKLVYEWVYYLKYLNKHYPYMISLAIRTNPFDSEADVHVTE

SEQ ID NO: 340 - protein, 233 aa, Methanobrevibacter ruminantium
MIEELVTNMSITESGASASSPIFTITILVFTILLLIGIIYFVFKMYEQSKPTVESIVLIAVLTAIATVGRLILMSIPAVNLASFVIIMVGVVFGKEEGFLVGALTAFVSGIFMGMGYWVIFQMLAWGLMGASAGYLASRFDSLPFRFIFGLLWGFLYGWITDISAIFYSGTALQITPIIALYINGFTYDLTHGVTNAVLLVVLYDWFKKMFTRAKIKYLSNPSSSDESIDLTN

SEQ ID NO: 341 - protein, 351 aa, Methanobrevibacter ruminantium
MELTAIHPGVYLLYYFIMVLLAFIFSDPYFVLSFLALILILIALQGVSSELKNIMKFFIPLSVLIIILNPLLNRTGAHRIYLFNGFFITYEAIAYGILMSLALLIVILVFSSYNRSVSYQEMLYIFSKKLPIISMIIVMALRFIPLINSRAIEVQKLNNLKANGVESDEEDDLNDDSLEDNLSEENNLSDENNSKEDSDSLDLEQFDSNISSLDIGSDSRVFKKIKSSKRFQSIAKEAKVLGKIMGITVSWSLEESMFTAKSMKARGYNSNERTSYLSYKFGLADIIFLAIIIVTVSIIVIGLIQGYGMINIYPSIDFSFSDLPFNIYYFAFIVFLLPLIYLEIKERFLWR

SEQ ID NO: 342 - protein, 261 aa, Methanobrevibacter ruminantium
MMDLISGIIYLILFIIIMVFAFSMGILSPYVGRREIISIIAIGFVLGAIGGYFFIYPMYQDSPYVLGNLQGLFTMESEIINLNIPSTSNISDVTEKILNQNGVNSVSTNGFELTTSSINNETKTYIDSYLKNDSQIERYSIGTNNISVDLKNDASSTATLGSLVTWLSNTVGVSSEFAFVHIKVNVNANQVLDIKEYLRDNHYTIVSVEGPVQDTIHYFYDHLAPDYVVMCITGIIGVLVAIAGIYVEPLTKFVRAFRRGG

SEQ ID NO: 343 - protein, 284 aa, Methanobrevibacter ruminantium
MSGFIMVFFTLLLANYYDLKYGIIPNKLSVFLMTFGILINVLILIVLNNRLYAIFYVSYLIIIFIISFVLWKISFWGGGDLKLFCSIGFSLPFIDILNHFYTGSILNSFSFNSQIILYPKIFSILINSILLSFPVILLLLVYKLLRENKLNLILFAFSNMKLLIKELSTKTVFINDLKEGMIVEDYYFNSLELFNLMEELTGNEECYNLKASQFKENSYVLKSSSMAGLTRDDIKLINFAYMETLINFPNFKIKMGVPFVPSLTVGYLVFLAFGDLVFLISTII

SEQ ID NO: 344 - protein, 495 aa, Methanobrevibacter ruminantium
MSDKNEWGSNLSFVLAMVGSAVGLGNIWRYPYVLYSNGGGAFYIPYIVAILLMGIPFLILEYGVGYNFKSSFPKAIRKISSKAEYLGWLLPTSVFIIMIYYSCILGWDGIYVILSFFKGWGADPNTFFASTLLQSSESVSGITNFIPVIAIVMLISWGIVWYISHKDLEEGLGRVSKILVPLLFIIMIVIVLFSLTLPGAMIGLNELFSPDWNLLLDFNIWMAAFGQIIFSLSLGMSIAFTYASYTGKEGDIITNTLAITFANCAFENFCALGVFSILGYMSLQSGTAVADLVTQGTGLVFVAYPTVLNVLGQYAYVIGPLFFITVYLAGLTSILSTIEPLSFSIQNKFTWSRKKTMTVLCLIGAVLSMMYATAYGGTLLGYVDAYINQIAILFGVILECIVFAWIFKCENIIPILNERSKTIKLGKWWVVIVKYILPLFITIVWIGGVLDTINDGSTDQLIVFGILTVILLGLTALFTHLPATNEEWDETEYRL

SEQ ID NO: 345 - protein, 119 aa, Methanobrevibacter ruminantium
MIDSFRYALNGIAVSIKDERNLKIQMIVMMLVIIAGFLLKISRTEWIICIILFALVISAEMINTAIENAIDYTREMTVDKDNDLARIAKDVSAGAVLVIAIASAIVGLIIFIPKVLLLL

SEQ ID NO: 346 - protein, 50 aa, Methanobrevibacter ruminantium
MIWREKSLKDVLEIAFAPLFFWLIEIGFALFVSLFIGVFIDMIIGIEAMV

SEQ ID NO: 347 - protein, 403 aa, Methanobrevibacter ruminantium
MVVLSAGDTAWVLIATILVLLMSIPEVAFFYSGLTKRKNVLNTMFLTFIAFSIASIIWVVYGYPFAFGDVSISGLIAQPAHFFMSGIGIEDLTGTIPTILFIVFQLTFAGLTAALISGSIVGRMKVSAWIVFIIAWVTLVYVPIAHWVWGGGFLMQMGSLDFAGGTVVHINSGVTALALALVLGRRKDTSLLPHNLGYSVLGAGFLWFGWMGFNGGSALAANGLAASAILVSNVAAATALITWVIIDIVKVGKPTMLGAITGGVAGLVAITPAAGFVDVPAAIVIGFVTTFVSYFAIYYLKTRFGYDDALDVFGVHGLSGIWGAIATGIFAVPAVGGAAGLLYGNPGQVTIQVISVIVTIVYAFTISFILAKILDKTMGIRVDEKTEIEGLDTKIHKESGYRL

SEQ ID NO: 348 - protein, 183 aa, Methanobrevibacter ruminantium
MNILNLPLNILIGNGISFFASIALILSCVVNDKREAYKYQVIEALILTVSSAFFLSWTGILTMLIAAARNYLVMNERLSSRLAIIFIIITLIICPLINTMGLIGLLPMIGIIQLTICNYYLKTIKWIKVAFIVNVLIYAVYFIGIYDLVSCATQVITAIIGFISLVKLIKDEKEGNIDSQPNN

SEQ ID NO: 349 - protein, 90 aa, Methanobrevibacter ruminantium
MSDDELYRRAERKVDEKIGFYKHLYSYIGVNILLFAINAITSFGKWWFYWVTIFWGIGIVIHFLKTFVLTGKLEDNREEMIQKEMEKMKK

SEQ ID NO: 350 - protein, 316 aa, Methanobrevibacter ruminantium
MKRLFKLVEKYFFIIIIIAVAIAVVFPGSFDWVMGEFMGINIINILLGIILFGMGTTLKIENFVNVFKRPKEILLGVGAQYIIMPLVAIGVASLFGLNEALTVGLVLVGTVPGGTASDVITFLAKGDLALSVSLTAVSTVISPILTPLITLILIGNNIAFNPVDMFISIVQIVILPIAIGLLLNYKFPDFCEELKDYLPAVSSLVIAIIVAGVIGANKQAILGSSVVIIAAIVVQYFIAMLLGFVIGYLSGMKRKQMVTIAIELAFQNSGLSTSLAKTHFPALSLATVPGALYSVWQNFAGSILAYIFRKYFTDEE

SEQ ID NO: 351 - protein, 902 aa, Methanobrevibacter ruminantium
MNEEHYNKQLLRDYQESTDLSVYDHREEIDYDEDVDISLCGCPDCADDHDHNHDHDHDHHHHHDHDHNHEHSHEHEHSYSHEHEHEHSHEHGHEHGDEHSHEHSHDHDHGHDHEHEHGDEHSHEHSHDHEHESEDTCGCGCDDDDCHDDLEEHSHEHDHSHDHHEHDHEHHHEHEHDHHSHEHEDEHHHNEEHSHEHEHSHEHDHDHEHHHEHSHDHDHSHDHHGHDHSHHDHDHGDSCGCGEDHDDDDFSLCACPDCADDDDDDHGQEELLAEGKPLIYNRPIQIMVSSGILFITGHILEFLSFSPTIVTIIYMLGALIAGYEIAILAYKSLVKRHTVGPALLVVIACIASFIIGHGEEGAAVALLYYIAEFLEDLAEHRAKRSIKSLVEIAPETARVKVGDGEESRRIEEVKVGEIVLVKPGDKVPLDGEVVYGTSSINQASITGESLPVTKTVGDEVFSGTVNEDGYLEVVVTKEAKDSVINKIVTLVKRSQLNRSTTETMVEKISKYYTPLMIIIAACVAFVPPLVFGQDLIDWIYKALSIMVISCPCAFLISTPIGMVSAITSATKKGVLIKGSTYVEEMRNVKAVIFDKTGTLTEGKLELNDINIINDEYSEEEIVRIAASLENSSSHPIAQAIVNYANEKEIGFEEIEDFRNVPGKGIIGNIGGKQYYAANESLIEGSQFNISQEEINQYSAEGKTLIFIGDEQSVIASITVMDRIRDNASEVIKDLKSQGVKTFMLTGDNKIAAGKVADEIGLDYVYSNLLPEDKLNILDTLRNKFGDVAMVGDGINDAPALARANIGIAMGAAGSDVAIETADVALMQDDISKLPYLFSLSQKTMNIIKQNITLAIVVKALFVILAILGLITLMMSVGIGDLGLTLVVILNSFRIAMVKDPLF

SEQ ID NO: 352 - protein, 682 aa, Methanobrevibacter ruminantium
MSESITPNGGAKYSNNKNKALASKKGNDSYYKNVLLIGSPNVGKSLTFNKLTGMTAMVSNYPGTTVDIDEGNFTYENKTVHITDPPGLYDLNTITEEERVAKLLVLDKRFDLMVHVVDAKNIEKSIDLTLQLIDAGKEVILVLNMMDELEKMGATVDAPSLSHELGIPVVLTAAAQNRGLDDLKHTIVNYDSIENQILSESKTLLDVDYGRSIEIAISEIQRNIKGNYPVSKRYLAVSLLEGDEDSEDLLMESEDWDNLSQVIGAQKAKFDQPVKYLTKLRLADYAKHIKSSFTTIDSVNIQDTDSLGEKLSRIMIHPFYGLIILACVLFFGLYLIVGVLGAGILVDFLENTIFGQYINPAVTSVVVQYIPWVPIQNLFVGEYGIVTLGLTYGFGIILPIVSLFFIVFSILEDSGYLPRLALLVDNGFKRIGLSGRSVIPFVLAVGCGSMATMVTRTLETKRERNIATMLMALTIPCSAQLGVIMALLSARPRSIWIWLAVIVFNFVVIGYLAKRFVPGAQPSFFMELPPLRWPKLSHIAKKTWTRLVMYIKELIPIFILISVIIWALDLVGIFQWIIACVTPIVNAIGLPGSTSSSFVLGFFRRDFGAAGLMTIQNQLTGVQLLVASVTLTLFLPCVAQLMIMIKERGVKLAGLIAVMSIVLAFSMGFIVNFILTSLNVVL

SEQ ID NO: 353 - protein, 134 aa, Methanobrevibacter ruminantium
MIVGILSIILAIVVYFITPPYIEFYLIFVFLIPAIALIVPNDAIKNSRAIGALTFILVIIVAYFAISGMLGAYDVLTNMYVNGLINSTPSTSDISACSNGYLMVLIYALFNIFCGALFFKRTSSIDDVDDEDAF

SEQ ID NO: 354 - protein, 258 aa, Methanobrevibacter ruminantium
MASCNIGKKFIAELIGTFFLVFFGTGAAVVTLLISDSVTPGKAGIGLLGGLGDWIAIALAFGLTVMACIYLFGKISGAHLNPAVTIGLLASKNISAIDSIYYIVAQVIGACLGSLLLYVCLGAQAVTIGGLGATAPGMGVGYLPALIAECIGTFFLMLVVMGVAVDEKAEPGFAGISIGMTVAAVIIVLGAFTGASINPARTFGPYLMDTLLGGTNFWGFFPIYLIGPIVGAVLAAILYGYLAKGNDACALPQPFFEE

SEQ ID NO: 355 - protein, 360 aa, Methanobrevibacter ruminantium
MYLGSSFAFIAPMVAGYAIGGKSSIFSALMVVGLVYVAIAIIIRATGKEWINKLLPPVIVGPMIMVIGLCLAPTAIQEIGLDQAVVPINNIIVALAAFLTTAVIAIRGKGVLKVIPFLIGIIVAYVVAALLGMVDFSGFFSASLFEVPEFYMPFINYSFNPTALLTIVPIALVTMVEHVGDHKVLGEIIGRDLIQDPGLNKTLLGDGLATFFAALLGGPANTTYGENTSVVGLTRVASIYVIGLTAVFAVIFAFSGHLTALLAAMPNPVIGGVAILLYGFIAVNGVKLLIQEEVDFNNNKNIVVAATMLVLGLGGATLSVAQGDLSVSISGMALAAIAGVILNLIIPERKEDNKFVPEVK

SEQ ID NO: 356 - protein, 574 aa, Methanobrevibacter ruminantium
MYIKSFFNDLNLTKKDGIYLLALTVFSILYTVHLIDVNYTLNFKSDPFVYLINGLVYAGMQGHIENYSYGMFLTPVVSFLTSLLFRMGIVDKIAIMIVSGVISILGEIGLYLLFKTKFNEVYSFFGCILFASFHIVLTIWGGGGIDIPVCAFSIITFLFMVLAVDKNPKYYIPTSIFLIISIFTKYDALFIIPILFLYYLTKHDFFNLVDLALSDRDELKIVIKNYIKSEEFKYIVISLIIAVVLFILFCEVIWSYGANLTFLTQSQESLNGFNSAKAARSHFYYNDKKFYIRNLYTFFYPQISQEFSLIIPAIIAIGTVFNFANIIRRRKEYPMVRDYKTPHFKYLLVGLIIILIPIAIIGFKYISHMVTNVALLTICVCLLSLADKFDIDKRTFNLDIFFLAWIFVFAVFFSFITIKGQRYLIIALPAVVYFVLRTIEEIFNKFKDSNILKITLIIIAAIIIVYSLSFTFTDGNFDTERNNTAIQEVYDYLVEYDPDYLNKNLSSDYSYGSRFGTWTLKKDVRYVKLGVIDQSESDYLIVKHDNVSLANYTEIYRAGKIKLYQNNMYDNSSI

SEQ ID NO: 357 - protein, 170 aa, Methanobrevibacter ruminantium
MAAIICPRCGKMNDGSLDFCIYCGTYFDDYNEEDNNDNLFFIRSMTNDGRPGKKQVVRLNEMPDNLQKPKHRLAILLGYLFAILGGLIGFVFAIYLITRKDKNARRHGLIQLVILLIEYALIGVLILNGQLDINMVLDPFNMTRMNNITQLYNSSQMNVSGSNISSLFGF

SEQ ID NO: 358 - protein, 110 aa, Methanobrevibacter ruminantium
MEELYYMIYIIVFIVGSILGLLLSYKKHMEPFIISEIDVLTLVLAIVGWFLLLNHGLIGFVSSVILLTIAFFCIGLAIGRRPGYGRKETAIGILVAVIVWILTSGVIFKF

SEQ ID NO: 359 - protein, 286 aa, Methanobrevibacter ruminantium
MNLMAQILINVVIAFLAGSLLLGFHRKVMARVQLRPGPPIIQYLLHSLKFFFKETSFPKTASMPFYVGITVILAGIWVTGVIVGPVCKGSLMIIFGIYAIHKIVEHNAGSSSGSPYGKLSCVRAVFSAAGELPLFAVIAVVFLLTGTMDIGGIIQYQAANGPLAFKIPLAAIMFFTLIVTKSPYSPFAITKGKEIITGFETEHFGMLRGYIMFSESIAWYILLWLFLTIFFAPIGVVGYLIGMILICVITGFINATTPMLNPNHSVMAQISIAVICVVGSIIMIII

SEQ ID NO: 360 - protein, 222 aa, Methanobrevibacter ruminantium
MLIENLGGDFLGTIPLGDIVLYLNPLHIFLFVTILLFTALIAISRTETQVEAMFGSLDENKVAVGLKEFKHRRFLAIICGIATAGAMITGDLFNFTLFMALIGIVNIGIVSAVKQVEVLNSAYQYGLIAMMCGLPLFGGAAIILAATGTLSLFELASIPANPMMIFGALVMLIGVCGESGIAPFFASKAEMFRTPGSPFILIIHLSSLFLIVRFIEILLTIL

SEQ ID NO: 361 - protein, 225 aa, Methanobrevibacter ruminantium
MVASVIPQVVPAFYSSMYTTALYGGLIVAFIGLIGVAMEKRDIQILILTDIVGLAMLIVVAAVGTDLSEALILPGLVVELAEIMAISEILISREMRKADKDTSFSPMPLDIDMEIMTTAPNFIALLLIGYGIFLSGFTGGAVAGGGIVIYVLSRKVRGLPIFVLDGVGAISGISWCLWIIGFIFFFILPQYWLLSLFLAALGLLLKVASKIGLIGILMREEYGRK

SEQ ID NO: 362 - protein, 113 aa, Methanobrevibacter ruminantium
MLEFINIETISMALMIIGAIGVVLLKKPLDKIIMVSVLEAGLFLAIVSFKYLDVAFLTAVLDPLSIIVFLLALIKINKVRKSKLEDYSTLDKLNISTENLEEKSLDKNSEGGK

SEQ ID NO: 363 - protein, 92 aa, Methanobrevibacter ruminantium
MYIEIIGVITILMALRAVITKNRAEKLLYINVIGFCVSAIIALYIKTTFGFVLAAAFFISSTIGSNAIAYSLKDLEDEISYDKDMEERDEEN

SEQ ID NO: 364 - protein, 166 aa, Methanobrevibacter ruminantium
MDMIIGIILAAVISWINFVVVDTFLGLPEAPGVKGAETVGYSIKERKGDLAGGFFQGNILCSPDASAGTLIAAIGVYALGIQGGLIAALLVYIGNRLCADPGYAGTCGALTMTLLIFIFSFVGIEVEMFICGMVIAIFTIQGIHHPTSSRLLGKIAKSFGRYTKYE

SEQ ID NO: 365 - protein, 92 aa, Methanobrevibacter ruminantium
MAIVVAVIIAFALRLPLLPERPIRFSWTTSALFPTPIFAIGILAIFYSLNVYWIYDGLILSVIVGLASALFVKYGFDYIFPKPPQIEDGGNV

SEQ ID NO: 366 - protein, 48 aa, Methanobrevibacter ruminantium
MEIDELITYLIIIAVVAILIKIFSWLLPIFVILAVAYVIYLYITENNA

SEQ ID NO: 367 - protein, 253 aa, Methanobrevibacter ruminantium
MKKIIEKHYGIHLNPNDFLPIEEIKSLMQLYFLLIILLIYICIMNFFFNNFGISGELIFINSLIDIILSVFLVTIYYDGSTRGKIISIFLLPIVSISYILFGGSLIRYWDFIRIPILLYLVVIFYNKFIDYTERNNLGKTILILLSIIYTGILLTIVLEKQNPIDAVAMVTNAITSNGYAALGDSEGGVLTSVFLAWGGYIISGVATATLAADIIHRNSRKKFRNMETKIDNLENKIDNLERIIVESQKENEE

SEQ ID NO: 368 - protein, 365 aa, Methanobrevibacter ruminantium
MSFLTLILKNPFRSKSRAILAIIGIGIGIATIIALGAITDGMIASADDTLHAGGCDFTVSGKIESTSSQMATFGTSTIDEDYIDKIANVTGVKDAIGMYMTVLMTTNSPYFAVVGLDPEDYQVSDLTITEGRMYKNDTNEIVIGKIASENEEKGVGDTITLDDKKFKIVGIYESGNTLQDQGGFTAIKNSQKLSKDEGKISSIYIKVNDGEDVDKVRDRITDKYGDNLTTISSLSDLEMTKNMIDMLNGASLAISLLAIIIGAVGIINTMLTSVFERTRELGVLKAVGWSDEKILLMIVGESIVITIVAGIIGSIVGVIGVELLAASKIMQLLNPVYSVDIFVKAFAIALFVGIIGGIYPALKSH

SEQ ID NO: 369 - protein, 459 aa, Methanobrevibacter ruminantium
MQTNKNIESIIGDPKKAINRLTYPTILSMLLMFANNLIDSMWVSGLGAEPLAALGFMSPLYLVIIGFGSGVGAGANSLISRLIGAKRYDESNNAAIHSIIIALIVSIIISIIGMFFLDDLLVLFGAGSVLDYAMDYGMIIFLSSIIILFPAIVSSLFRAEGDIRRATVPLVVNAILNIIFDPIFIYIFNWGVKGAAIATVLSTLVNLLMMLYWYLVKRDTFIKLSLEYFHSKMEIYKEILFVSIPASLEELIYSIVAICFNYLIMITAGTMEVAVFTVVWRFVSIAFLPCISIGISTITVAGIAYGARNYENFKTTINYSTFLSFTITLIICIIFFVFAYPISETFNFISGDAEMISRTAEVLRIMVFYNIVIPFGGTAVYVYQAIGSGFKSLAITILRELILSVFLAYLFGIVLKMGIFGVYLGAIVGMAIGCFIGFTCIKIYQGKFKKECESLNQPV

SEQ ID NO: 370 - protein, 636 aa, Methanobrevibacter ruminantium
MFGKDKKENSNEKVLYEGQPNLIVYSKSIFIAVILLGFLFFLYSTGIQYIGNMQVYMIESTKLPLTRYFAIAVFVIIMVVILYIIIKFLSWTSIKYTITESRVIVEKGIIFNKKNYMPFNTIQDVSRSQSILGKAFSVGTITLYSAYDGKDMSLKDVSNPKKIEDLIFENMRTTHLRSHNLYDDSYGNPYNNSYNNHNNHWGYDNYGDSYQNRDFKPIRPNSDEKVHYNRMEDLDDLELVDVKERKRNLREIRRKAKNSRGNNYNNQPIDGPSNNYNRNSNYDPNYNRNSNYKQNPNYNNRNNYDDFGYDDYESGYNQRSKRAPQGNRGYSKRNANQYRDDSRANHQHRETIRESYQRNPNKYFAQNYEKFHQDNLEAQNRGGESFNEMNPLDSNDYYGMDDDFISDEEFDSTINKAMENIGDNIKFKPNNHSRVVNSHEDFDSRVVNSHEDFDSRMNDSYDDFASGSRHNTDYANSNQNRHYNSNYPDDRQFRSNQSYEGDYRQSRSNQPYEGDYRQSRPNRSYDDGYGHSGSNPNYNNSYDQSNYGYDDYRQSNNPPRLNKQSSSDNYHKSNNRNRSSNYRNRSYNNQENYNSYNDMEDNSNNYEESDKKGKKKKKNKDSNDLLEKHSRKFRRS

SEQ ID NO: 371 - protein, 358 aa, Methanobrevibacter ruminantium
MATFKGFAMKRLNEIGWVEKEVPECGPMDAIIKPTCVSPCTSDIHTVWEGAIGDRRDMILGHEAVGEVVEVGSMVKKFKPGDRVIVPAITPDWDDEAAQRGFPSQTTEPLGGWKFSNFKDGVFGERFHVNMADANLTFIPDGLSDEGACMLTDMWSTGMMGSENANIPLGGTVLVIGIGAVGLSAIAGAKCLGAGRLFAAGTRPISVEVAKKYGATDIINYKNGPIDEQVRELTDGAGVDSVVIAGGNLENTWAEAIKSAKAGGTVSNVNYLSGADNVLIPRVEWGCGMSNINITNGLCPGGAVRMERLADLALCGRQDPELLVTHKFKGLEKIEDALLLMKDKPKDLIKPVVMLDID

SEQ ID NO: 372 - protein, 245 aa, Methanobrevibacter ruminantium
MLKQIIRKNFTSKYKDSVLGILWSFFNPLITMALLTAIFSSVFARNIENFPVYFLTGRCVIDFFNSGTKIAMTSLKKNSGILNKIFVPRYVFALGGIFSEFINFLMSMIVLIVIMIVTRAPFHLYAIFSVIPIAILFILILGVGLTLSILCTKFTDIEYLYKIFTSLLVYACAIFYPIDIVPQPIRQYMELNPIYGIIAQFREFVMYGRFPSTKLMLITFLTSIVIFIIGVIIFKKYQNRITLEL

SEQ ID NO: 373 - protein, 276 aa, Methanobrevibacter ruminantium
MGYLTDLFKEALVYPLSNIVTLIILGVLLTISKFPNVLSSFGVDVDFQLIIIFALISFVVSLFMDGYSLAVIKDAVDFNVSMPAFDIMKNFIDGVKVWVLKILYYIIPTIITIFVALLTGGVDAILNIFRFIGENQELLSNLNTPAELINAIPQEYIATFLTSLFITAIVAIILYIIFGLLYNIGLCRLAKYDSFNEGINFKAIINDIKAIGLGTYILWYIILFLIIFAISIVMGLIAAIPYIGIILLNLLFAPFIFLLVNRSLGLLYTKAEGYNG

SEQ ID NO: 374 - protein, 233 aa, Methanobrevibacter ruminantium
MEDFKYYKNKIKEEIKLAFAHNKYFLIVSALIFIIPMFVGYFYSDQITPYIQPMVDTFEENIRNGTVTLSTKSLFANNVEVAIILYALSALGAILGIVVLANNGLFIGFYGANFELTRYVLLTLPHGIFEISAIIIATTGGFVILSFVLNFLYNVIYPDYSYTDIFDPYFSDAKITVGQRFKSSFKKHGHRIKESFILLCVSVILLIIAAFIEANITIPFAYWICSLFGISLI

SEQ ID NO: 375 - protein, 646 aa, Methanobrevibacter ruminantium
MAKRNFSESLGKIVTLLKKDFTDVFTKNPVVPIVLLAIIILPSLYALINIQACWDPYDNTGNIEIAVANLDNGTTFEGESLNVGNEIEDELKGNDDFYWVFVNETELREGVKNGTYYSGIIIPKNFSKSIKSITTDDPHSAELEYIVNRKSNPMASKLSDSAAKAVYNKINAKIVQFINVVAYSKLGELQSALSQGAGQMSSGAVQLSSGSAQVNSGASQVKSGSNQVKSAANQVQSGGAEVQSGSEEIKSHASEVKSGANQVSQGSSQIQSSSQQIQAGSSQVQSSAKQLDSSVDVDKLPSDDLKHVVNSSKQLANASSNLAGSSSQLANGSVQLANGSVQLADGSVQLADGSVRLADGSVRLANGSVQLADGSVQLAEGSLSLAAGSQLLANSAAYALFAASSSLSGAASSLSSITGVDENQIGSYIYSPVTLNEIELNPVDNYGSEVAPFYLVLSMWVGALITCVMLRTGQSTGTEYSPSEMYFGKLLIFMVMAVLETTVTLIGASILGIEMSNPVLFVLSAYFIALVFMLICYSLTSALGQLGKGIAVIWLVFQISGTGGIYPIQLMGPILQAVSPYMPMTHGITLLREAALGLVWSNYIHSFLILIAMGLITLILALIIKVFADKRAHWFEEKLNETDLFH

SEQ ID NO: 376 - protein, 66 aa, Methanobrevibacter ruminantium; identical to SEQ ID NO: 271

SEQ ID NO: 377 - protein, 475 aa, Methanobrevibacter ruminantium; identical to SEQ ID NO: 273

SEQ ID NO: 378 - protein, 275 aa, Methanobrevibacter ruminantium
MTISPKRILYLDEVRSLAIMLVVIGHLARLFSYNYNSWLFCSGVFSLTRIGVPLFFTVSGSLLLTRKYEVKKFLEKRFKRVCLPFFSWIIIYIVAGVLIWHYDLTFEYVVNTAFGVGDYSALFWFIWSLIGVYLLIPVISSFIREEGNWGAEYLILITIILSLLYTFGFFDYPQMKYNFRVIFNFFPVLGYFIMGSYIHNKKFKYSDKKMFAIGCVLFIVGICGHFAKIYLKGLGGLSLAPIDFFDICVIMETIGLFIAFKYASTKWDKRKDARN

SEQ ID NO: 379 - protein, 85 aa, Methanobrevibacter ruminantium
MQEIEFRETKLGEVIVLFASCSFGIYFSHYILMRYIMYNGFLAPIRKTHALFWLPVSSIIIIGLSWLLIYVMSKIPYVRIASGVK

SEQ ID NO: 380 - protein, 239 aa, Methanobrevibacter ruminantium
MEIGEIITDSLKYPINNIKALIIYIVLGIVAGLVLVLTGVGVGAGAIANSAAATGIVGIIGIIIFFLIYLLILGYELDVINFGIERRDDAPEIDFARQITNGIKWYITCFIYMLIPTIIMIILSYLNQTLGLIVGIILFIIAAFALLMAQCRLAHTDSLGEALNIPEAIKDITKVGIIKIIAVFLILVILGLVVSFILGLFSVLGDVGTYIGAILSGIFTIYLAFVVFRASGLLYSDAV

SEQ ID NO: 381 - protein, 262 aa, Methanobrevibacter ruminantium
MAQIKCPDCGKEQEDTNKFCKNCGANLSNVKAEEVKLDLDAAPTEEKIDLNTAPTEEKLDTDASEVKETPKAPVENKKICSKCGHELNNEKFCPRCGQSTASIVPYEAKTESQGENNDKTCPSCGTKVTTEKFCPNCGSKIEEKKPVQTQNAPQKYCRNCGNPIDPKAEICPKCGVRQLTVVKKEPLFSLILSLIFPGLGQFYNNQTHKGIFLIIGAIVSIVLTIFVIGVLLYMLVWLYGMYDAYSTTIALNNGEYVEDKLF

SEQ ID NO: 382 - protein, 539 aa, Methanobrevibacter ruminantium
MQRKTLSRFDEIVKILRKYDMDKVLGQTTRNRISPFRSGSENKELLKEDFPERLRLTLQELGTTFIKFGQLLSTRPDLVGERISEELSQLHDDNPPIDFEEIKVIIEEDLGGNLKDFFTEFSDTALATASIAQVHEAKLHSGERVAVKVQKTNVQEIVETDLNIMKFLANESDRFNTTFKHLNLPAVVKEFDRSIHKEMDFDNELMNIRHLRDNFIHNDKIIVPTIYPDYSSERVLTMEYVDGVKLSEVIAGDDPKYNKILIADRMVRAYFKQIFLDGFFHADPHPGNIFITDDNSICFIDFGMMGVLDENFRQDLAELMICFSNRDIDGLINQLIYMNILNVKTDISILKGDLNDLFAKYYGVELSRFNGVIEDLLFLMQKYDVMLPNEFVLMARGLSMVENIGLSLDPDIDIVEIIKPFARKLMIQKYNPKKMVHNARNTFFTVEHMLRALPSLVSKTFYKVDEGELTINIEVKQISEITNQISLAIIIAALVIGSSLAMMVEAGPKLFGLPLLGFVGFTISLALGVFTVVRYFMDF

SEQ ID NO: 383 - protein, 325 aa, Methanobrevibacter ruminantium
MAIIMKHRLNLDNKDPNYILLKEIFKIMDSRKSKSILASYGFKNLNRTIFTFKIIFISMFFGIDIPFILNELKSKKELRKYFNISEVLTADQVYKIFSEINSEKLIKCLNRILNSRNMVKRRGKKTFIVDATPVDLDINFRRNKKSKEHLRKLNLKWSYSSSKGYYIGFKATVVMDYDSMNPVCILIHSGAPNDAGLFEEILENLQKRRIIRKGDTLIFDKGYYGYKNYQIGIGKYKIVPFIFPKEKFNRTRLDDILTYPLAVFNKTKKIMEEKRLYNKLKKELLEKLDSWEKFKPIRGKIEDFFQIIETRLEYERNPQIYSKIS

SEQ ID NO: 384 - protein, 191 aa, Methanobrevibacter ruminantium
MALELMNLLISILGAVYFMLPAYVANLSGLAFGGGTPIDGGANYRDGNRIIGNGVTWKGCINGTIIGTLVGVVLGIVGMYYGDLSTLTGGVIDLHVYGSLFSGLILGFLMAFGALFGDAVGSFIKRRMNLQSGQPAPIMDQLDFVLGALIFSLLVVRISWSFFIIICLLSILLHLSSNTIAYLLGIKDVWY

SEQ ID NO: 385 - protein, 213 aa, Methanobrevibacter ruminantium
MFEFTKNELRDLVIAFIVLSIAFAIANVKFDLHAFISILPIVMFGVGVGFLLHELGHKYVANKYGYKAEFKLWPIGLLIALITSLIGWVFALPGEAKITAENIDEETTGKIAIAGPMANIGLGLLFIVIAAITYPLKSSFTLFELIYLVSTVGFSVNAFLATFNILPFYTLDGTKVMKWSVKAFIVAFAIAAIMMLSSMFIGAENMILMLIGS

SEQ ID NO: 386 - protein, 344 aa, Methanobrevibacter ruminantium
MGLITTGMEQSVQTTMNEGAAEITVTNITSIGAGTIDSSLVDELKNITNVSRTAGILSATDQNFVDMASSNDMSSMESSTRLYGINRADLDLEGIKDINGSFFEEGTKQAIIGKQYAQMNNMSIGDNISALGEEFEIVGVFETGGVLADSGVYVSLETLDEVTGAEGKVNQVIVKTDEGVNDTVVADAIEDKYENLTTITSEEMSQMLDNVIGILDAVSVAVSALAIIVGAIGIVNTMVMSVYERTKEIGVLKSVGWKSRKILKMIIGETLVLTILSGIVGSAFGILIAEVGVRLMGDTDFALGYSPSTFIMAFGITIVVGLIGGIYPAYKASKLAPTEALRYE

SEQ ID NO: 387 - protein, 284 aa, Methanobrevibacter ruminantium
MIKKKTNDKEQWFIYRANLRTKTLVIIGLAALIIISIFVCGYFIRDIPTNFASANQMPSLEHLFGTDWMGRDMFQRTIAGLGLSIMVGFIASVLSTIISIVLGLFSSFNKFADEAVAGIIDLFGSIPHILLIIIVSIMFGGGVWGVIMGVGLTHWTPLARVLRSEVKEIKTKEYIALSENLGRNKVWIAIKHIFPLIISQIIVGVILMFPHAIMHEAAITFLGFGLPPHEPAIGVILAESMHYLSAGYWWLAFYPGLSLLIVVLLFDLIGENVEKLLNPETAQS

SEQ ID NO: 388 - protein, 329 aa, Methanobrevibacter ruminantium
MNKQKIAKYFGWKLVRFVVLMIAVAIFSFVLLDLSPIDPVNAYLKGAAVTEAQRAILQQYFGTNVPLPEKIFHWLMDLLQGNLGTSLIYRRPVMDVIIDKFMASLALMTISWILSGIIGFALGVVAGKNKGSWIDKAVKVYCYAIQSAPSFWVGMLISMVFSVYLGWFPIGFGVPIGVRSTDATFIEWATRLVLPTLTLSLVGLAPIAMYTRNELVQVLSSDYVLFAKSRGEKGWALIKDHGLRNIMLPAITLQFLSFSELFGGAVMVEQVFSYPGIGQTAVAAGLQNDVPLFLGIVVISAIFVFVGNLLADISYYFIDPRIKENEFND

SEQ ID NO: 389 - protein, 235 aa, Methanobrevibacter ruminantium
MEFLKLKRSKIFLLSVLMAVLPALLMYIATFAFDEVQAFDALFTNVNMYMSVLFAVLIFAIIMAYLFGREYNEHTLKMMLTIPISRGKFLLSCFLLFLLWLLVLSVLSCLSSLIFGFAAGLSGFTVNLLINSFAQLLFANLLLFLTFSPFVFISLFVTNMVPAMVGGASLTLVNMLVYGQTWAPYVPWVCPYLIASGEIAEYGINMLLPYGLVFATFIVGIVISYLYFTKKDVPL

SEQ ID NO: 390 - protein, 380 aa, Methanobrevibacter ruminantium
MENHKALIAIPIILALLSLALISFNGIEQGVELKGGSLAELQLTGSTSVNDLESQLTKELNTNNIKVTSNGENKVTVELENNVNSSTFSKAIDGKAKVISYNEIGPVLSEEAMGQIYIAMLFAFLFMAVTVFIVFREPVPSVAIILAALCDILIALGGMSILHIPLSIASVGALLMLIGYSVDTDILLTTRLLKRREGTVDERARNAMHTGLTMSCAAIAAMGILYIVTVIIMPEATTLSNISAVLVIGLIGDILSTWLMNLGILKTYIDWRQSKKQDKFNIDAPKSNESKSKSKEEDGKSESKSFKDRFKRSKDDDSKDSESEDSSKDSESKDSSNDIDSSEEEKSSGKDKKSSKKTKSNKKGNKRKTKKSKKKGKGGK

SEQ ID NO: 391 - protein, 407 aa, Methanobrevibacter ruminantium
MASNLSKFFKDRQVIILIICLIISIISISFLGVEQGLDLKGGSSIQLQLEHPVNDSTMKVVTSVLDKRLNLYGVTDVKVRSSGDQMVIVEMAGKSPEEVERLIGNPGIFEAKIDNKTVLVGSDVATVDAPVVGESGEWQVPFTLTTEGAKKFAELAKGKGGHEVVMYLDGKQIDDHPPALAEELASGEAVTEVQVTGGAEDVETAKAESNEVFTVLKTGSLPVKIHTVGSNTVSPELGQQFAQGALIAGLLAILGISAVVYIRYRRAFLAIPILITTLSEIIIILGVASIIHWNIDLAAIAGLIASVGTGVDDQIIITDEVLHHDDENTRHRRTRTQMNVKNALFIIFASAGTLIAAMLPLAYVGFARGSSGIGTIAGFAFTTIIGVLIGVFITRPAYAKFIELFVS

SEQ ID NO: 392 - protein, 142 aa, Methanobrevibacter ruminantium
MWEMVWPILLVILSNTIYNICTKSTPGNVNAFGTLMITYITAAILTAIIFVFLVKPENVMVELSHVNWTSVVLGIAIVGLELAYIFAFRAGWKVSSASIVANIGLAIVLVFVGAILYGENITLKQLGGIFICAVGLFLINMG

SEQ ID NO: 393 - protein, 456 aa, Methanobrevibacter ruminantium
MQEANEDIDLIVNHPKQAINKLALPIIFSNFFMVLNNIIDGIWVAGLGSNSLAAVGFVTPLFFAMVGFANGLGAGANSLISRCIGAENYQGAGNSAIHSMMLSIIVTIFATIVLLVFLNPLLMLMGAGEIIEETSNYGYIILVGAYSIFLPAMMAAIFRSEGEINRASYPLMLNAIINMILDPIFIYVLGWGVKGAAFATVLAGTFATLPMVYWMFIKQDSFLKIKLSEYKTNLKIYKDILVVGIPASIEQFIISFVSILMNYWLTLLAGTLAVAAYTATWRLVSIGVSPIIGIGVAALTVGGAAYGAKNLKNFKTALNYSAILGIISSIIICSIFFVFAEQLSFIFSYSADSAILAPRVVDALRILCFFILLMPLGVISGNLFQAMGKGTISLVLTILRSFILEVIFAGIFAFVFDWADIGIYTGLVCGMMCGSIVSYLYINYYLKKHEDYFIVK

SEQ ID NO: 394 - protein, 241 aa, Methanobrevibacter ruminantium
MFIGLLAPAIVSTVFIMLSGSDLLKKDFKNKMIGFYKVKWLNVIWAVIVFAIVIVCSILLSLLFGQPIDQFSFTESFSFTGVGIAGAFITITLASIIEEVGWKGYCEDSIGNYMNWFWESMIFGVLWSFWHFPLIFISGTYQAGLMVNPLYVINFFVSGIPMGFVITWVYLESDRSILACMIFHFFVNFMQEKIALTPETKCLETIVITVVAILIVMAKKDMFFETRHVGRLLEYNSSQQQ

SEQ ID NO: 395 - protein, 457 aa, Methanobrevibacter ruminantium
MEESKTRFEGVESILGDPKKAIWKLSIPLIISLFITSLYSVIDAVWVSSLGADALAGVGFVSPIFIALMGIGNGLGAGATSAISKYIGEGDKKKSDNGAVHAIVITVIVSIFTTLLFLIFLRDILLSMGASNTIDYAMDYGVILVSGSILVILSNSLYGVLRGEGDGNRTMYAMLFASILNMILDPIFIYYLGLGVKGAAIATLISLLFVNLLLFYWFYIKKDTYLRPFLSNYRFDKDITVDILKVGFPASLELVNNALFAALFSLLLTVVASTDAVAVYSTGWRVVTIATTPMLAVGTALISVVAANYGARRYEDILLAHRYSMKIAVLFGFIAAIVVYVFAPQIVSIFAYTGTSMRLSSQLIAFLSVIVIYFPTMGYGVTSTFLFQGTGNGITAMFQTILRETVFTLGFAIILAVVLGYGEYGAWWGIILGELVVNTITMFWADWHVKRLIRSNN

SEQ ID NO: 396 - protein, 467 aa, Methanobrevibacter ruminantium
MAGLNLIDSVMYYPILIIVMAIAGLYFTFKTRGVQIRLFLESIRILTEPPDEEGSISSLQAMLVSTASRVGTGNIIGVSTALCLGGPGACFWMWVMCIIGASSAFMESTLAQIYKRKDKEGVFYGGPAYYIEHGLHKHKLALLFCVFLLATYAVGFNMLCSFNLQSTFMEYPFYHPSITPIIIGAVLAIITCYCLLGGGKRIVSVTSTLVPVMGVSYVIICLIVILFNIQNVPVMFLLIFRDAFDFQSILGGVAGSCMVYGIKRGLYSNEAGVGSAPNASASADVSHPAKQGLAQTLSVYIDTLLLCTASALMCLSTGVVRDAAVSGAPYVQNAISSVFGWIGPIFITVAMILFAFTSLIGNLYYTNNVLMFMNNEKMPSKRFVHIFHIACSLIIFIGAIIPMDAAWAMADITMGGMTLINLPVCLLLSKAAIDCLKDYERQKKMGLKPVFKASSIGLNEEELDWWK

SEQ ID NO: 397 - protein, 467 aa, Methanobrevibacter ruminantium
MNVFRSFIDILSDRTVNERGYFFSNKALFALFLPLLVEQALEFCVGLADSMMVASLGEVAISGVSLVDFLVQLLIFSFSALATGGAVIAGQYLGNDEPEKACDASNQLVWFTTILAVIMAVLVLIFRPFLINLFFGQIEPDVFNTSSIYLSYMAISIPFIAIYNSGAAIFRTMNKANLPMQIMFVCDILNVIGNAILLFVFGFGVEGVAIPTVLARALAAVIMIYFVLQERYEIHIRKTLRHKFDWVLLRKVLNVGIPYGVENGVFQLGRILILSLVSTFGTIAIAANSVGYAIGIFSVLPGFAINLGLTAVISRCVGHNDYEQAKFYNKKILIITFLSHLAINLLIFALLPYILQIYNLSPAASALTYQMVVWHGIFAVLIWPIAFTLPTTFRGAGDAKWPMAVSLSVMFICRIALSYVIADFMGVGVFGTWIAMFIDWYVRAAFYVYRYFSGKWMEYRAVGTNLS

SEQ ID NO: 398 - protein, 319 aa, Methanobrevibacter ruminantium
MRTLEWEDNKLKLIDQTKLPDELTYVYCSNYKQVITAIKDMIVRGAPAIGVSAAFGMALAQLAGEDMEKVAVEMKNARPTAVNLMWAVDRVMKAENMLDEALEMAREDINTNLAIGEYGAELIDDGDTVLTHCNAGALACVDYGTALGVFRSAFNQGKNIQVICDETRPRGQGASLSVWEMQQEGIPVKLIPDVASGYLMSIGKIDKVVIGADRVAHDGIANKIGSFMVALAAKRFDIPFYVAAPISTFDKEISIFDTEIEERDPNEVIYYGGARICPEGTEVINPAFDIVPKDLITGVITEKGVFDLNNLEKDFKELF

SEQ ID NO: 399 - protein, 217 aa, Methanobrevibacter ruminantium
MLLSKILEELLWGMGTSIEIFLLTLLFSIPLGLAVAAGRMSSFKPLQWFMKAYISIMRGTPLMLQLIVVFFGPYYIFGMTLSRDYRMIAVIIAFTINYAAYFAEIFRGGIESIPNGQYEAAQVLGYTRVQTFFIIILPQVVKIVLPSITNEVITLVKDTSLSFVLAIPEMFTVAKQIAAAEASISALLIAGGFYYVFNALVAIIMERFEKRLDYYDT

SEQ ID NO: 400 - protein, 37 aa, Methanobrevibacter ruminantium
MMVFGIEDPWIWGVYVLLIGMTLVCVAYGALNWNNED

SEQ ID NO: 401 - protein, 534 aa, Methanobrevibacter ruminantium
MVGYVGYLAWKRTNSSEDFLVAGRETHPYIMALSYGATFISTAAIVGFGGVAGKYGMGILWLAFLNILVGIFIAFVFFGKRTRKMGKNLNSLTFPEFLGRRFDSKFIQYFSGVLIFCAMPIYAAVVLIGAARFMESSLMLDFNLALFILAVVICGYVLFGGLKGVMYTDALQGTIMFIGMLILLVFIYWVLGGVTEANTALTNMAHLYPPDALAEGGTGWTSFPKLGSPFWWTLVTTIIMGVGIGALAQPQLAVRFMTVKSNKELHRSLLIGAVFIAVMTGTAYIVGSLCNVYFYQNFGQIAIDYVGGNMDSIIPTFISTALPEWFVYIFLLSLLAAAMSTLSSQYHTQGTALGHDIVDAFKNRGTTREYTDEEILEGSSKEETRIGFISVSQLGILIAVVLSLIIGLILPGGIVALGTSLFMGLCAAAFLPVYCAALFWKRATRKGAIAGLLSGTFTSLFLLVFVYKKTAVGLGICKALTGMDMLINVMPWYSIDVMVFAIPVSVIFTVVVSLLSPPMDEKVIKRSFEGLSEE

SEQ ID NO: 402 - protein, 425 aa, Methanobrevibacter ruminantium
MLDRLKSISLGNWILIGMVLGLITGVILNLYVHSQFIDIILIDNVFYLGGNIFIKLMKMLVVPLVFCSIVVGVASISDIRKIGTIGGRTILIYLITTALAVSIALLIASFIHPGAGLHMAGLATASNVSTNVTITNTILGMVPDNPINSLANGDMLPVIIFGVLVGIILAKLKEETETINKVFEEGNTIMMEMTSIVMKFAPIGVFCLMAKTFATLGFDGLMPLSKYVICVLIGLAVQAFIVYPSLMVIFTRLNPIKFFKKFYSVMLFAFSSSTSNATIPLNLEKLSELGVSREVSSFTIPLGATINMDGTAIMQGVAVMFAAQAYGMDLGASALLTVIFTAVMASIGTAGVPSVGLITLNMVFTSIGLPVDAIGIIMGIDHILDMFRTAVNVTGDAICTIIVSFKNKSIDLDVFNGKKQAEGSS

SEQ ID NO: 403 - protein, 129 aa, Methanobrevibacter ruminantium
MFLDRFSLERNDLNFRKYNLAILIASLLLYLLNIYFLSSFGDFFKFYFDDLFAIMVLFSFLNLVFPYKIDNFWIIVIITIFAAFFWEYVALFIKPGSVFDYLDILAYFLSMVIYLILIYAFEGELNVSF

SEQ ID NO: 404 - protein, 75 aa, Methanobrevibacter ruminantium
MEDEVIDVEDYEVKETAIVVSDDEEDNDYSKSSNDNNYTSNTTFRTATISLSNEKLIILALVAIVLIAIFLLTFC

SEQ ID NO: 405 - protein, 472 aa, Methanobrevibacter ruminantium
MVLICPILAEEAHATTVFLTSDNVLGHDEDMQMLNDIKQQIETKSNGQITVIVDENASNPGEGTRAMNADCDIAVTIAYACAGNLVDLGSYSVQSTKKIIYVNAGSLDLTSINFLRRSYDDNWSSSSFASLQNPGQYLYDSGITLLQPGQKFYGETDNGNLDHCSSEIDGYIADEVMKQVYSNGVIRKLDSDYINRHKLDPKYLAEDSKKIVDGFGTPMADSYGSYTTQQLLYMSASYLVGYSLDVPQQFAPPENPAEYSAFTKGTYSFNEYCEMADIVVDYMNEHGKAPDSISYKGATISYYDLVYNFALLTQDDFDAAHMNFPQNADFQKYNSNILLDILPIAIIIVVIIAVAIIIRKLIKKGRRGIKRIKNRGKDNNYYRNQASGNRSRKSRGGSRDNYSRNSARYNNSRGNQSSRKSRNSGRPRNSRNSRDSRNSKNKRSTKLFHKNVDLDQYDNSRSKEPKRLNKKR

SEQ ID NO: 406 - protein, 906 aa, Methanobrevibacter ruminantium
MIEEILKTYNTTIEGLTNHEAKERLEKYGPNKIQEQESDGLLKLFLSQFADALIFLLIIAAIISYLIGNHLDAVVIVIVVIINSIIGFIQEYRAENAMQELKSLVSKEAHVRREGKTKIIPAEKLTIGDIVLIEEGNKVPADLLLVESYDLTIDESLLTGESEEVRKNADYSNMGNLEEKIRNISSHYQEEELREKIVSMNSNVLSGRGTGVVIAVGMDTTIGKIATMIQEEDEETPLAKKVDKLGKRIGALSIAVCIGVFFIDFFQDYNIIEGFMTAVSLAVAAIPEGLPAVLTLTLALGMQKMAKSNAIVKKLSSVETLGSCTFICTDKTGTLTENRMTVREDFLLDNDKSVLISGLCNNAKYETVDEGEYESLEKDNNRARNSSEEDSKKTENSKEESQLIGNPTDIAAYNFAKGHGFDKLDPEHSYTRLDEIPFDSNRKRMSVIYKKETQNETEYYIFTKGAPELILNLSDRIEKDGNIKEIDSETISKINRKIDEMTNKTLRVIGLSYKQIDEEDYNKIKNSHNDNKIHDIQEELERNLIFTGLLGIMDPPRAEAIDAVASCQKAGIEVVMITGDHKDTATAIAREIGILSKEDCESLSKHVLTGEELDRLNDDEYRNIVEEIKVYARVYPEQKRRIIDILQSKDHIVSMTGDGVNDAPALKKAAIGVAMGSGTEVTKESADMIIQDDNFATIVSSIKEGRTIYDNLKRFLKFQLSTNIGAILTITIGSLLPIPTPFTPIQLLWINIIMDGPPAQSLGLEASEDNIMERPPERGELLDKKTLIKITISGIVMTIGTLSLFIYELGLNSPYGKTKAITMAFTVFVLYQLFNALNYRSKSNVKNKMLIFSLIGTFILQVLVIYVPYLQIIFKTCPIEPFDWILVIILSAIILVTDKIANRLIN

SEQ ID NO: 407 - protein, 40 aa, Methanobrevibacter ruminantium
MNLIADIASGLFWMSLVMIGGFIVVIALMTLIGKGSSADF

SEQ ID NO: 408 - protein, 181 aa, Methanobrevibacter ruminantium
MRTEVRIAGFGGQGVIMAGIIIGKAASLYDNINAVQTQSYGPEARGGASRTEIVVSDEEIDYPKVTSPDILVAMSHEALIKYMGDLKDEGVLIIDPDMIVEEEIVDFVKEHKIKLYRAPATKTATEDVGLRIVANIVMIGAIVKVTNVVSVDAAKKAILDSVPKGTEDKNIQAFEAGYALI

SEQ ID NO: 409 - protein, 253 aa, Methanobrevibacter ruminantium
MDLKNIKIATIITIIAFIIIGLYALTEVNYFSYKNVVEHDDINASVVIIPSIGVFEKINNVSISQGVYIDQMSNLPTKGDVVLFGHRTLQGSPFLRLDSLKKGDIVTLEWPEIGEINYTVKSSKIVPASYGLYLNESHMEGDIHNQEIYLITCHPLGSSAERLIVVGELNSTSLINETALEENPHASWAWYITLGFFALGLIVSFLSPEEERKIILAVVIIITIILVYFCLFPISSQIWADQLGWLNSMMGVN

SEQ ID NO: 410 - protein, 643 aa, Methanobrevibacter ruminantium
MSNRFNSFKKGISKVKNISPKIKGNSNRKKNNSKNKRSKSTIEYIVPENSPLRKNSTDLDSDSGFFNSDYLDDLPEGVSYTRPVGDLSEGVTYTHPADDSYDLDGVDKRYAKYIFGDDLSDRNFKDPRDSSYMEDLDNNDGLNNEFGRNRNFHKSRNYADKRFNNDLDNNGENYKNDSYLDESYSDFSFKKDLDNGYLNGDAYLSNSDFSDFDKDYLDDSNFKSSHSKKASLKSNGIKSKLLNFKDGLLNKDDNSKSRFGKIVFILIFLVLASSMFYFFVYQPFQDELNLEKNAKLNELNTLYKGPLEAHENAYILKNQIESENDINELKKIDILMYATKDWRTYHKSKIVSSKDNFGRVMLAYGDENKNLIMSVKDANEFVGDNDGRVLSNIQFEKVDTIIVPVSISRLQASAGLISVGSIVDIYSLKDNYSYGGDEDSNFESSSALNESSEGLVENQSEDNEDLGGGEDISKMPVDSNPEEDSGFSQNGEPDVSGATVLAILRSKDSGVIDSSISKSNTLVEGNLTDPYENTSSYTNDVEELLKASVFNSYDDNKALEYYLNSYGIKLSNYERMSNLADLDSEYLVLLEVPRSDVSFVINNMDNLILTIPTEFAPNWVIGELNETYYDNIYNYDLNSSSFI

SEQ ID NO: 411 - protein, 314 aa, Methanobrevibacter ruminantium
MRLKSVGMGYFLAVSDAISILNIAFGFLAILMVIDNNLIYASLCILLAVVFDSVDGWVSRKLNRVDPLGFGMNIDSLADIVSFGAAPMAILYSIGSSISSWAGYLIAIVCMITLVCGLLRLTRYNVIADKINYRGFVGLPIPATAIILVTYYLSGLFNIAVAAVLMLLASFLMISTIRYPKVDNYYLIGLGALMILLLILPIQVFIGPINLPALVLFVLALVYMFMTFLEFFIDDDMTFDRDKASDKVSNVREITESKVSSSVTNVKDVFKNMKDTINQISNEDLDVGLKEDAEEEKEKEEKEVKEAEIVEEVE

SEQ ID NO: 412 - protein, 133 aa, Methanobrevibacter ruminantium
MAIDIKRHKEKLRQDEPEIKLVPFIDILFTLLIFLVVTSTFGAATVDDNGSGSGKPNMTDTTGDAEYYLIPVAGLQKVTVDGVDMSSEIKGNAIGVHARVLDQGDVQIKTSEHAIIIKAPPGMSPQEAVHTPE

SEQ ID NO: 413 - protein, 279 aa, Methanobrevibacter ruminantium
MIIEMLTDGFNMIMEMLQSGGVITYIILLLGIYGLLISIRKIFYLRKISKIDATEIMGTITSSMEQGGAIEALKNISHYKNPVSRIMSEALKIGYKNKTEVEESMEQIFIVELSKMTNGISALKTIIELAPFLGLIGTVLGIWMTFKNLGVNPDAAAMAEGIYIALITTIAGLTVAIILMPLYTYIKGLIDDEMDKIELATKMTNWSYAVIKIRVYEKLPCVVEALQEADGIVSVKEITDPYSNIQISFKPSMLEKSISNIILEKCDVKSEITESKLRQ

SEQ ID NO: 414 - protein, 346 aa, Methanobrevibacter ruminantium
MASFIPTLNGLGFAYIGAKEFKNNWIIEGVIYEIPWFLLFIFVNNEDLGVFFATIGLLGMAVSFVRSLYVYYKHKDILIDDDAESRISTEKSITSFWVIFSVIIFLNGLGLIYVGFKRNVRQWILEGAFFEFLWLLFFITPSNKALNSFIISLGFIGMILSVIRTFMVYFEEERMDGGFYSPTAVKKEPPAQNPIENTINSYSENNLSDDDIVPEFKGYKTQVEDLKDAFKTKEDNVNNLLSKRFTKEELSYGRFKSVVNEFHKTFYSQADSTLTMINLAPEYSERVDETIKNKIGLMDSLLGEMNNLLEELILNDGLPEKSDEEITELFENMHNLINSVDDYNKE

SEQ ID NO: 415 - protein, 658 aa, Methanobrevibacter ruminantium
MGIKEFFLNKEKRKIVAIEKDLNNNLSILGGYSMGIKEYFIEKIDIIFILISIIAIALDLLGVDIYGISLIWIAIIFCGIPIFKEAAIGLYTEFDIKADVLVTIAIISSILIGELFAAGVIAVIMAIGGYLEEYTVSKTRAGIEKLVDLTPRKGRLIENYNKSNESEREISADLIEVGDILKVVPGETVPVDGKIISGETSIDQSVLTGESIPVDKLEGDEVFSGTINLYGSFVMKAIKKGEDSSLQRLIKLVEFSNPNDAEIVKTADKWATLIVVIAFICAVLALVFTGEIIRAVTVLVVFCPCALVLATPTAIMASIGNLSKRGILVKEGITIEKLAKVDRVVFDKTGTLTYGKPTLTDVIVYDEETEEKELIHLLASLENLSEHPLAKAIVKYYMDNYDDTLLKLSDFEMIIAKGVKANLNGSNICAGNLEFFKSLGIDIPEEFIEEIVSPSLEKGATAIYIAKDSRFLGCALLSDVLRKDASDLVVQLRRLKVVSTLLTGDNKQAAEYIAKEADIVDYQYNCLPEDKISTIKKFQSLKLNVAMIGDGINDAPSLRQANVGISMGGVGSNISIEASDVCLVSDDIKYVPHLLALSRKTIRTINRGIAFALILNILATVLAMYGMIGPIEGAFVHNIGSVIVIIYSSLLLRYEYAN

SEQ ID NO: 416 - protein, 438 aa, Methanobrevibacter ruminantium; identical to SEQ ID NO: 286

SEQ ID NO: 417 - protein, 661 aa, Methanobrevibacter ruminantium
MKVVVCENCGAKYQLNDDDDINAFECSNCSGSLKELESFSDEEIPKQSDESSGSDSVLVYCINCGLKFQIEKDDNINDFECASCGGPLDYLSNKSEESQESQISQDSQGSDSYYETVSYVQSDDIIPIHADPNYSDSDDIIPIHAESDSQTPYYEELIESDEIYANQYEDDDQYYVSEYEKVLQSDADSYYEDEYDDQYYQTDLQEEGSGQISLDELYYTSEYPAYDGTDEIIPIHAEKRYMEDSQDSGFAYGPNGKYAEDYLEEEYIEEEYVDSVEEESPYVEVIDIPEDELPETPVVLTRQVLSEEDQRLFDRVQNQMVFDSPEEYEAFKAARYKYYVGLLDILKEEYLLSMENEFKSGRSVKNLIKKGGETVKQSNLYADDSDSLVSPETVELMKSNRKYEPKKSNADVIIIAGFFIVIVSLAYYFFVSQIMYVLIAFALGLVILAYGAYKKYVFNEYIARGRIIRERLLALPNDFYVFYAVQPPQSKDIINHVVVGPTGIFTILSQRYDSKDYKNKLKSDTETGDMLSESASIQDYRQKKNTLELQTDYDDNQSRFQFGNEEIHFTQNSQIKRKALELNEDLAIFLDKKGFNGIYIEPLIGFVNDDLAILNVILTNEDLFIDELFNKVIRGRKRLDELTVAKIARLLSYYSANCDVY

SEQ ID NO: 418 - protein, 595 aa, Methanobrevibacter ruminantium
MMFSNISKDLNIERKDYLCLFLLLVYSAIITVLLINFNESIGIYCSDVYIYLYNSLVFARMGYNNTYLYLSPLDFGLVELHFLFRLGFVNEVSIYAVTGVFSIFGSLGIYVLLKRYFNSLLSLAGGVLFTSFSLNLLWWANGTLDLPAVGLSVWAILFLILAVDESPKYYILSFVFLVLSIFTRYTCLFLIPLFLLYYLSKHDLFGFLDSLISDRKEAFSSLRSFLKTEEFRYLMIALVLALIVAVLFISVILYYGAELSFLEQGSTFASGSKGALDDYAHTTDTLFYFHDFLNFLFSQKVIFQENFIPTLTGASYLAYLILFILIIGISLGIYRFFNKNKSEDKKQFDNVNSSISNLKEFSFKTSHFKTLLYIGLLLSLAIAILGFKINSIITIAFLLIGLVIIFSLLKSKGLDRKDYSVPIFMIGWFLVYFIFFTFLNIKVNRYIITVFPAFIYFVILALNEIIGLLDGKSLKIGDLNLSNIIPIVLIVLCMFSAFSFTSTFEDNLDFNDYKIVADYLIDYDGDYASKDIAVFKQRTFNWWLKDSTIAVTTDQLDFLESSNITYYICDEDLKLENYTKIYNYKDIFLYERVNN

SEQ ID NO: 419 - protein, 293 aa, Methanobrevibacter ruminantium
MNPYLEIIRPGNAVMAAISVVLMMIVGHYYDLPIILCAVIVFVCTGAGNTINDVFDYKIDEINKPNRPIPSGRISLKNARNYSYLLFAIGIILSFVIDYMINSIWPSVIVVPAVVIMYLYARNLKAMPLIGNITVATLTGFCFVIAGTVIACATSSLRILFISIYLGLFALFMTLAREIVKDMEDIEGDKLEGARTFPILYGKKIPSIVSIILIVVTTLMCPVLYIFGIFNVFYMIVMIVPICMFLYCAYSLKLNPPEEVCAKVSKNLKIAMLISFVAFVLGSFDWFSIFAAL

SEQ ID NO: 420 - protein, 204 aa, Methanobrevibacter ruminantium
MRKMDKRINFVSISRFTLLVAIFLLIINKIQFHAKILDYMALALAIFAIICIIIFIIQFKKGLVEFPIKVVVETNVDKALADGAITEEQAENIPKRVVLNANDIFLNLVFNLAIANHFDLLPVDVLREYIPDIPPANLMRLYEKSREISDDLNDYFRSQKFLNKADVITRSDEIKTYLRETYPWMDDVTLDNTFDYFFLGIGNG

SEQ ID NO: 421 - protein, 405 aa, Methanobrevibacter ruminantium
MSKKNKANKNKKKKESDQTIHELEIGKLIKNEDVLYINNPDYFLTFSDLEISDGIDIIENIMILSKDYVSFNRQYEDEKISDVELMEITEEYKENNNIEGGYISQSFDNSQFIINSYNDITIITVISNDLEVQKFTDNLKVVNSWKGFHNAKINFGQIILIDHALSPKLLIQLYKTATKQKAKFFESLHMPLHINNILNNEDFLVIASNLPEETLNQDYIMEIGLDITNMEYEDDKLDLEEFQERIEDGVTISCEDAIRKINLNIGILDYFVSEGILIGDLVELGMELLENTEPTDELKEKLKKQLLKSVSDRNINALIMAAIRLEDDFRKQRVREIDLNEKLVHFYPDEIIGVAIANQISGTKGVLNYRRYSRHKPGILYGLGPILSNTFAGLVAGCMTKILEE

SEQ ID NO: 422 - protein, 409 aa, Methanobrevibacter ruminantium
MECYNHPDREAVTTCSVCGKAVCPDCAMEIAGNVYCKDCVNEIVTQSIMEKASTQAPKEAAEPITEEVQEAEAVEEAIEEPVEIITPVQQEEVEEIIPETPKKAPENFEPEVEYETEYVETYDEDGVEDSYYENPEIIPEPEPEYKERERIVKEEAKAKEEEEIIEPVHKTEDIPKEAYMDDMEADFYEEQPSKAPSKDLEAKYEKYLEDLYYDEDEIEEEIYEAPKTQKRRSKPRRPQREDSYYDEDHKRSPRNYSNQGEYYINPREEEFEEEEFITPSHSRKRARSEETESYEELKRRIERNYAKEQEAKENRRFRRSKKSKKQKRPDYEYDELENIQEMHSFPEYEKEDKIGILDIILAIILIVLIILLILYVIYLFRLNGEYFSFIDSLLGLVRDPSGYISYVLN

SEQ ID NO: 423 - protein, 83 aa, Methanobrevibacter ruminantium; identical to SEQ ID NO: 20

SEQ ID NO: 424 - protein, 68 aa, Methanobrevibacter ruminantium; identical to SEQ ID NO: 21

SEQ ID NO: 425 - protein, 245 aa, Methanobrevibacter ruminantium; identical to SEQ ID NO: 22

SEQ ID NO: 426 - protein, 106 aa, Methanobrevibacter ruminantium; identical to SEQ ID NO: 23

SEQ ID NO: 427 - protein, 233 aa, Methanobrevibacter ruminantium; identical to SEQ ID NO: 10

SEQ ID NO: 428 - protein, 233 aa, Methanobrevibacter ruminantium; identical to SEQ ID NO: 11

SEQ ID NO: 429 - protein, 290 aa, Methanobrevibacter ruminantium; identical to SEQ ID NO: 12

SEQ ID NO: 430 - protein, 370 aa, Methanobrevibacter ruminantium
MTIISKKVELIELFYDLIFVYAISRLTSIISEPVNGGIAPFSLFAYIITSFVILQAWLYFTNYVNRYGQWKWYEYVIAIINMIAVIYMANTISSTWNNYFVFNVSMLIMLFTVVFLYSVHAIKEKSLKGAAGNSITILLVVCSIYIISTLSILFGHMDVVIWLNVLAILTGAFLPFFLKGKFDKSIINFPHLIERFELLTIITFGEAVVGITHFFNVNNFDFVPILVFLIVIGMFGSYVLQIHYLVDHHREERSLRLMFSHYFIVISINLVTVAFELIHSGEINYWIPSLMVIISLIVFYLSIMANKEYYYDGLELRKKDIALMVLISLIGSIAILLSVGSIYGFLIGALIITLANFGVLLNKYQKFNDN

SEQ ID NO: 431 - protein, 147 aa, Methanobrevibacter ruminantium
MFIIFPLFSANLISIIIGISVLIFGIGLAYSSFITHEISGALSSVMGIFGIVMIIFGLCFIFAINAISFLVGLQFYIVAFMLIMIAVVGFLSDSNVARTGALLYLVLGIVILLIAMFAAENPILITIILGVILIAQGIMGLIYGNEI

SEQ ID NO: 432 - protein, 388 aa, Methanobrevibacter ruminantium
MRRECLKIIGTAHVSQNSVEEVKEAILEDKPEVVAIELDRGRYIRLMNERNGIVEDDQIHITKIIKENKVGVFLVTTILSYMQNKIGDDLDIKPGSEMIGAIDAAEETGSRIALIDRDINITLQRVLNHMSTWEKLKFIYGIIGGLLSSDDEELDVEALKEQSAIDEAMGYFKEISPGAYEALVNERDAYLANSILHIPEDHVIAVVGAGHKEGINRYLDNPETIPPHSELIDMDKKGGIPWLKIILALIPISFVVIFFLAWMNGIHIEGDIVQFIVISMIMGFLGSILSGSKLASAIIGGLVAPLTIIHPLLAAGWFSGLAEAKFRKVRKQDINNIGKIESFRDLWNNNIFRILLVVVGTNLGVSLATLVILPSQVFIPLFMKIFGG

SEQ ID NO: 433 - protein, 45 aa, Methanobrevibacter ruminantium
MEMDSIIIISEILIIIILIVLNGLFSLAEIAVVSARRIRMQKNCR

SEQ ID NO: 434 - protein, 299 aa, Methanobrevibacter ruminantium
MLLIKGADVFVDGASNVAYNLKIPTIIVGLTIVAFGTSAPEAAVSITSAFAGTNAISLGNVVGSNIFNILAVVGVSALLGTLTVDKVLIKRDFPFLVVSSIGLLLIATIFGEISRLCGIIFLIIIIAYVYVLVQEARQDKEAMSEEIEVKLSIPKAAIYIVIGIAGIIIGSDLVVDSSSYIASVFGLSDVLIGLTIVAIGTSLPELVTSITALKKGDNGIVIGNVLGSSIFNILFILGISGAIMPLPIAPEMVWDILLMTVITIIGAAFAYTKNEVDKKEGAVLVALFILYMAFVILRN

SEQ ID NO: 435 - protein, 38 aa, Methanobrevibacter ruminantium
MDSDDLDWKNSLIAYLWIVMIWIGKIVNDYRIIKIHKN

SEQ ID NO: 436 - protein, 500 aa, Methanobrevibacter ruminantium
MPLILVAFASFIIALDATFMNVSISPLVIDLNTDVGTIQTIISFYTLITASLMLISSKMQDVFGKKKIFLTGALVYGLGAFIASISQNAIMLFIGWSLLEGIGGALMTPATISIISGTYDGQMRTTALAISSAIVGIAAAIGPLFGGVVTTFLSWRYGFVFELLIILIIFIFRKRIPNFASTASKKDLDITGSLLSAIGLILLVLGVLMISGKTIGLSIGLIIASIIVLIGFGLFEKRRKANGKMPLFDVSLLKDRNLSRGTLIRLITAIAMGGSLFSISIYLQTVLKLSAFNTGIVLLPLTFGMLIFSIMAPKFAIRLSHKYAMIIGFSIAIVGCLLLSYQFTLTTRFIDLLPGMFIYGAGLGFPMALSVDTALINTPPESQSSASGFVSTGQSLGMSMGTAIIGIILIVGAVGGMHDAINTYAPDKVTNQEFHDNVQGYFEKLGNVNTTELKHENSLKEKIVSKVVQDAMRLVMYVTALLLAIGGALTFTLKKQKIKG

SEQ ID NO: 437 - protein, 529 aa, Methanobrevibacter ruminantium
MGNKEEKKAARQRFDEIIGVAKRHHLAKLLTNNEDDEDFEVSDLRYAMEELGPAFIKLGQLLATRPDMVGNDIADDLKLLRDNTPATPFEEMRKVIEGELGKPLEEVYSEFNEEPLGSASIGQVYRATLKESGMEVAVKVQKPGIYDVIVPDVKILNNLAGTVDKHVSGSRTYNLPAMAKEFERSIFKELDYMEEVRNINKITNNFKDVEYIKIPEVYPEYCSSKLINMELIDGYEVTDLFDNEIEGINNTEIAQYGTQSYLKQVLIDGFFHADPHPGNLFVTKDAKLCYIDFGMMGVVNDTFRSNFAQLILLLLDGNSHHLINQLLYMNIISPEQNTDEFREDVDDLLNSYIGVDLDQMDGIFDNLMNVMINHNIILPREFIMIGRGILLIEDAGNRLDPHFNLTAELEEFAKKMIRTKFEPGNLVGGGFNYIVEIEHLLKDLPDRLNSTLDKVEKGELELNMNHTGLDDLKNQLSIALIVSALLVGSSIAILADKGPKVWDISAIGFFGFLFSAILGAYLVIKYIRK

SEQ ID NO: 438 - protein, 361 aa, Methanobrevibacter ruminantium
MVLLGAMIAYGLTPIANKIQTKIKYPSISIFLALILVVIPLILLFAYVFYEITVFADVFFNSSDLAGMDINNALNAFVGNLPVELQGFIKPYMGSLSTGLESALSYVLAYTVKLVKGFSNVLIQLFVLICSIYYFTRDGDLIWENIFVFIPNEHKAFFDRTFYEIANVLKSIFYGHFLTAVIIGVMGGVGYYLLGYKFALFLGIITGIFQLIPIFGPWIVYWALAIYAIFVAGDIVQAVLTVLWGFVLSLSDMYIRPVLASNYADMPSLILLVGFMAGPYVFGIVGFILGPLILGVCYAVIKSLKEELEKDNWNSGDEEGSDDGDSEDVKEISDNLDEVSDDKKDSNEDSKDLDLGIEEKI

SEQ ID NO: 439 - protein, 187 aa, Methanobrevibacter ruminantium
MKKIIGIIFIIVILVIGGSLVYKNYKDSQNTVDKSQESIEISKNGITMLIPGDWVEAKSESNTTAIAAADPASKDSAGFSSVNINIEKKTSYNSLSYEFNNNYKALGRDSSYDILYEGNVSIAGTEGMEAGYTSSKTGFLKQHKAIWFKQGDDLYVILCTAPQSKFAEEESTFDFIINNLKFNNSTN

SEQ ID NO: 440 - protein, 239 aa, Methanobrevibacter ruminantium
MKLMQILKNLERDYNDGLISEEKYIYLSNQYRHKIDTIDTSNRIRTMQGKKKVSPRPYSKYEDANYQKSRDEDERLVEKYIHNPESYNINSRGKKTKSGGTSPWYIALAVIFLLFAFGAGISFGIFSENTNSDVGDIITASATINDTAFPEVKQTYKYNRTSNYTKYSSNSYSSDYSSGSSYNSYNSYGGSGYSSGGSGYSSGGSGYSSGGSGYSSGGSSYSSGGSGYSSGGSGSVSID

SEQ ID NO: 441 - protein, 332 aa, Methanobrevibacter ruminantium
MSYEISLISILEVVLTLIIALFIGVLIPGIERKYVQARIQQRIGPPVTSPGLWASIKFLYKENIQPNSMAPGLYKAMPVLCFIVVLAIFLVLMPYNYQFMAFSSLIAIVGFLKVEEVAYVLMGSLSESVMSANLRFPDHIKGAARPDSLVSSIEDISSKRSLRMIVFGSFPLYLALFVPAALSKSIYLADIVAYQQANGPFLFTLAGIIGAVVFFVGYMIILNEYPFSYIKAKSDVIEGPYMELASKYRSFVYVTRGFLIFTLGLVFSVLFLGIPPVLFSWKFIAAVIVSLILPVIMASISAFSPIFTNKQLYPTILLVSAMGVLAIVIALF

SEQ ID NO: 442 - protein, 92 aa, Methanobrevibacter ruminantium
MFVLANLLIGPIIISVIFGFVLGSRIHLDEKNSFKFTASGIIALIIGALIVSYGIGQFPYYNDLPIATTFLGALFGLLIGSALLGGRAKGDH

SEQ ID NO: 443 - protein, 174 aa, Methanobrevibacter ruminantium
MAEDKDLKTTKKSPNWNKDESSPILKIMVLPISFIIASLGIMVILGGHITPGGGFQGGAMIAGAIILSVVVYTVNGSPLKLSHRFISLLESVGALAYVLLGLAGLALTGSFLYNVGGNLYGLVPQAIAAIFKYPDLTNAGMVPYLNIAVGLKVLVGLSAIVIAFSQFKKLAEEE

SEQ ID NO: 444 - protein, 87 aa, Methanobrevibacter ruminantium
MNNVSGAMAAEFLILVGLILAALFFRHINIAACIVVVILAAILFFTNMPLASKIKSEQSDSLEKMLFYVLIVLGILISVIYWGLKYV

SEQ ID NO: 445 - protein, 486 aa, Methanobrevibacter ruminantium
MVVIPILAALIVNILGGKDKTVKAFSIIVGLAIPIIAILAAIGVQYFGGHDPGLLANSLPSNLVGTLVASYNTGIVYIFDNIERIFIFLMGIVAFLSIFTYFTEKKEVSGPYLYLIFMGLASVIALLLSNDIFNMYVFFEITALTQVGIIVASSTEDNYEIALKYLILGSIGGPMLLLGVGFVLGTIGSVNITDIIYAISNNFVDPYSPGLVIGFALILFGWLYSAGLPPFHTIKSAVYSKARPNGSAILQGFSVLCMLAFGIAMYKIFAYIPGFNTAIIVFAILAMVLSIAMSAMEVDFRRMIAFLAVGELGFIALGFGIGTQMSIAAALFQAANEIVITAMLFIGFGSIYYLTNTSDTRKLGGLIGVDSLMGVMILLGGCALAGVPPFNGFVSKLMLVQAALEAGYTELAILAVIVSVVIFFTFVKAFHSVFLEPKPKDLKFVNEKIPRVTVFSVAVLLIICLALGLFPNIVTDVFIPFAGGLI

SEQ ID NO: 446 - protein, 122 aa, Methanobrevibacter ruminantium
MIMDIQLASLFASGALIIIGLIAAIFIDNIIKKIIGIAFIEEGVNLFLICLGYKAGGVVPIFLPGMTADWFAQNSAYPLPQALVLTSIVIGASTLAVMLALAMVLYRKHGTLSAKEILGDEK

SEQ ID NO: 447 - protein, 76 aa, Methanobrevibacter ruminantium
MIEYIIIIVAVISAIIALLQEDLLKSAILVGISGFFIAVLFHLLLAPDVALTQAIVEGAIVPVFIALAVYKTKGGA

SEQ ID NO: 448 - protein, 188 aa, Methanobrevibacter ruminantium
MALGLEGMNLITIIQSILLIISALIIIIAAIGILRMDKDMPNVVYARIHILGMIDVAGIIAFIGLGQPLFALIYIFLAPLLAHALANAYFHAEDDLNNPVLNPNLLNEESDESELEESVDVAEQDGEEPEESVDVAEQDGEDSDSEETSENVEEDSDSEEEASNEDVDNKTTEEDVENLNNSEGDDND

SEQ ID NO: 449 - protein, 88 aa, Methanobrevibacter ruminantium
MIMELLLISECFLIIALVVFLFASMRIITYKTVSMGLIGTSSLTLAITLILICVGMMWGIEFFKDIALVLLLLGIVGTIAYATFLRRA

SEQ ID NO: 450 - protein, 104 aa, Methanobrevibacter ruminantium
MFLSRIYYAIAYLVVLILEIIKATIDMAGRIFKGDQYDPIVIDIDTELKRPISQTILANSITLTPGTLSVDLDSESQVIKVAVIAPRDVKDIIPFEPYIKGMLE

SEQ ID NO: 451 - protein, 245 aa, Methanobrevibacter ruminantium
MSSYKGHTIFAFILSLLMFYDPFAIALAVIGANIPDFDHEFKRNHVLIIISIGMILSIFLYLLNLPIYLGLIIALLGLIFLLSSHRGFTHSILGAVVISIAIFLLVYFGMDLSSYFNLNTITNIPLNYVILVGILIFLAVLFLNKQLASIFILLMLFFITLVYFGIVPVFKINVYSLIFSVFLGLFSHMILDSFSPAGIKPFSPFSDRKCYKKLGLLLFALIIALYLILFPNKLDFYLNLLPHFY

SEQ ID NO: 452 - protein, 386 aa, Methanobrevibacter ruminantium
MKNRNVWRIIMSEIKKYMEDLKKNKTGLKGILVIILIFAYGILGSYYIMNLNINNSIYYTIITIATVGYGDIIPVTPLEKFFSTSLALTGIGLIAYIFTIIITSFEENLHDIRSGRHMEKRLAKMEDHYILCGFGRVGTAVYEELMKRNQKVIIIEKNEDKLEDIEETENVVPFNANATEDKTLKKLNIDKSLGVIVTTGSDVDNLFIVLTTREMNKDAWIISRASKKENIKRLKHAGANKVISPEVSGGTDIYFAAVQPNLVHITQKHGIDYLEREFEILKKHNCHLENIEYHFPGIKTPVTRTIGVLDEEEKDHFIDMVKNNPEVHESMDVMYETVNGVHSHWISGPDKSHVDMVIEELKKEGNLLGVNLDFKEINEFTKQFKE

SEQ ID NO: 453 - protein, 423 aa, Methanobrevibacter ruminantium
MKNKKLIIFLIFGLAIMAAMLYFIGIDQVVDALKYSNLWFVLLAVLLQIFTYFLYTWRWQIINKSAGMTLGIWKLLPMVLVSLAVNNITPSGRGGGEPVRAYLLAKEGHYKFEDTFATVIADRALDTFPFVILAILTIIAIIFSVSLPVYWIVILVLCVVGITAIVILLLYVCINEAFGVRLTEWILKITKRFYKNYNDALEKRIVEAVASFQSTMNALIRDKNIIYYALPLSFIIWVFEILRVYVVFLAFGAKVSPIIIGEVFILASLVGMVPLLPGGLGAIDGVMILFYSRSGITASLSAAATVVERSISFGMTTILGLIFLMKYGTSILDASFKLAESEKAENLEEITEDEQKILDQLSEDGDKSEDSDENREEAVLEVLDGEPSIEVVDEEPTIEVIDDEPTIDVLDEKEEAIDEKVKN

SEQ ID NO: 454 - protein, 475 aa, Methanobrevibacter ruminantium
MQGLGVVLIVPTLVALIYGEYDPIAPFMIPCFVSFVLGTAFSKKFKDYTKLRLKHGMLISSFAWLWASLIGASIMVLSLGIPFVDAIFENMSAWTGSGMTFFVNVEVLPKSILFLRSLEQWLGGLGIVIIFIGILIRAGTAASRLYKSEAREEKIKPNITNTLRKALEIYLIYTAVGIFLFILAGLPIFDAINITFTSISTGGMSIKNANVGFYQDSIVYLISMFLMILGATSFTIHYKIVKTKGKALFKDVQFQLLITLIIVAGAFFIATNKMVPIEELFTIVSAVTTTGANVVDPHVLATWNGSTLIVLMVLMLIGGSSGSTGGGLKLIRIITVLKGMNLTVTNLVSPEGRVVNTRIGGKKINEREIKEASAYIVTFLMFLVFGWIIMTMYGYDPFTALFDVISIQSNNGLSTGIVYGGLPLPLKLTLIFLMWIGRLEIIPVLVLFRTFYGLVNPKRRIKQMKKTNGNDKKTN

SEQ ID NO: 455 - protein, 280 aa, Methanobrevibacter ruminantium
MKKSSIIIFFAVFEIIAILLFITLNDIFYLFNFTYIGACLSIGLYLYNVDSKYSKYARNFIQLAIGLYMLVYLGIISRENMMIEGFWYYLFLGVFEAAVIHYLVAKILGPFLFGRGWCGYACWTAMILDLLPYKTPNKNLDHERKNFGFIRYILFIASLIGVGLLFMMNVPNLSTVMFYLFIAGNIVYYTVGIILAYALKDNRAFCKYICPTTVFLKIGARYSLLKVKYKRENCISCNKCYRVCPMDVDICNNDKNKKNGTECILCLSCAKECGNDALFL

SEQ ID NO: 456 - protein, 113 aa, Methanobrevibacter ruminantium
MARHKSNKRLNKGEEEDPMSGAANLVDAMLVIAVGLLVFLVISWNMQGIVFNEDMTPEEKQEVMQQMQQVTELEEGQELNDTPDVSNSSGKGYTEMGKVYKDSSTGKLIMVEG

SEQ ID NO: 457 - protein, 214 aa, Methanobrevibacter ruminantium
MVTVIPGSDLLTSALNVVSQSLQIPVIVFLLIFAVYAVITVGGLISEYSSRKKVPVKVIKDLIYAISRSEDVTELENILKNARIPKNQKRVLINIARSGELKKDSREALAEKLIENEEDIIEKKLQKTDIVTKIGPTLGLMGTLIPMGPGLAALGSGDVTTLSNAIIVAFDTTVVGIGSGAVAYVVSKVRRRWYEQYLSNLDALSKAVLDRLNE

SEQ ID NO: 458 - protein, 230 aa, Methanobrevibacter ruminantium
MLWQFGILAAVLVFGIKLGLAVGLANLSKKYLATVCIGYGAGVLILAQISSYFATEITELIYTYNSLFFIIMAVIMILAGIFTIREWKVFEKNTTAATCAAVIAPCPCCFGSIIVSILLVAPTVGLGAVDLSVYVAAALVLTIIVTYFASSIFVRYVDKPYPIVLGNFMFFLGIYFLLSALVIPNIAAIMNKSMGSISIVSMESLAGSIVALVLLVVIGIVFSRKNNILS

SEQ ID NO: 459 - protein, 116 aa, Methanobrevibacter ruminantium
MARRRCNRRFESEEEDPMAGTANLVDAMLVIAVGLLVFLVLAWNMQSVLFNEQLTQEEKQQVMDAMNQEMTEVQEGQILNETPDTSNATGQGYTEMGKVYKDPSTGKLIMVQNNSA

SEQ ID NO: 460 - protein, 248 aa, Methanobrevibacter ruminantium
MTLAIGNTLIFADEAIYQGANNGLFAIFSNTNGTGFPFLDSSLTAITQALQIPVIILLLIFLVFAVVTLGKLLSEYLSRKKVPIKLIKEMIYSIYDAQSAEEIKNIVNSSDIQSSQKTILCELADSEHLGKKSRETLARRLIDNEEDKITQNLQKTDIVTRIGPTLGLMGTLIPMGPGLAALGTGDVTTLASAITIAFNTTVIGIGAGAAAYFASKIRRRWFGEYLANLDALMDAILDNINKRDDRLE

SEQ ID NO: 461 - protein, 177 aa, Methanobrevibacter ruminantium
MEIIELIAIIILVAAIVFLIYYYFQTVNGGSFDIDDLKDHLTISKREAATATVNLDDDEAEEKVSVGKKIKYTFKDIDKSYSNTTDAFSKRLDAFLDERSEELIENWSLVTTDDLESLEKRCVTACDSIDDLEKRFSEYSNVTNEKLEDLDKRIKALEEDSELLEEDAETIEKEADE

SEQ ID NO: 462 - protein, 134 aa, Methanobrevibacter ruminantium
MANEIIPSEIFILILVVILAFVVIIIALQWKKVRQSDNTLKLMEKEIELKKIAMVEKDLENKRLMENPISLPSEQQEQLTQIRDSTAKVMSDVGYLHSEINERLARLEAQTELKKLEKMLAEIEDKEKKLNKGK

SEQ ID NO: 463 - protein, 399 aa, Methanobrevibacter ruminantium
MEKPQLVNFIAKVLEDSGFKVYKNFKTSQQTVDIYAVLPTSMGDFGMVVACKNYDKEWEVGIDVLKEMEVIGKKLKASKVSVVTSSGFSSQAKRYAEERKIKLVDRNDLVALAKKYNNKKKQENEPVRLRKESPANIDRDSFYNRDVSRDYIDNVNGTQYDAGLNRVPNPYDSYEEYESDIDYYENQVGGIDLSGYSAYDDDLYRAEFLNRHPSNESNYNGLLIANNRDPYVNSKPSSNSRSLFSRNKATEKLSSLNSRGYTKNTNNNNNRQRNSRTTTVSRNKSPSRNFISSRDNALSKFSRNESRSSGGLKEMIKPILGNTIVSIIVVIVVAYLIAFILGSIVKVPTGYLGLTELAVALVLSYGLVFYTDRGSDVLVKGTIIFFISLVVLMIILIAF

SEQ ID NO: 464 - protein, 274 aa, Methanobrevibacter ruminantium
MDILQAIIIGLVQGLTEFLPVSSSAHLIFIQQALGLSNVPLAFDVLLHVGTLVAVFVYFFSDIIQMIQGFFYSLLDLRDGNFIPEIRRDPYKKLAWLTIIATIPVGVVGILFNDIIEEMFTGLTIPAFLLLITGCLLYVSQRMNSGKIDVQNITIKEALLMGCGQAIAVLPGLSRSGTTIAAGLFAGLDKEFAAKFSFILSIPAILGAAVVQLKDLSGGNIEIGACLVGFIVAVISGYFAISFLLKIVREKSLDIFAYYCWIVGVIVLVGSILL

SEQ ID NO: 465 - protein, 251 aa, Methanobrevibacter ruminantium
MMLNYLFNILNTNTFLLNPKERVIQGILLFILMSVFSLLFISFITLASPNLFFPLLISFELLMLFLGLNISLHSIYTNYFNMLVSENPVLLSYEGVIVNLLCLSLGAFSFWLSIAIFIGPFWAFFSFALAWLLPLWIMFFRRDIFNEKSKVISKNSDKLIGYSPIWFYLFGCVSLFIPFLVMFKIVFFSKFNFLALGLIIITLIETILIFCPDYWDKILPFDIRTKKGTFIYFLLSILILSCISIILYKIV

SEQ ID NO: 466 - protein, 346 aa, Methanobrevibacter ruminantium
MLNLNKKTIIGVILCFILAIPSFLLGNLFPIIGGPIIAILLGMIIASFWKDKGSAEEGINFTSKYILQLAVVFLGFGLNLGVIVATGIQSLPIIIGTISIALIVAYIMMKVLKMERNSAILIGVGSSICGGSAIAATAPVIGANDEEVAQSISIIFFFNVIAAIIFPMLGRMLGFSTVNGDAFGIFAGTAINDTSSVTAAAATWDNMWGLGSATLDKAATVKLTRTLAIIPITLALSYIIGKKDNGEKSNEEGFSLKRAFPTFIAFFILASIITTVAVFLGVDASLFIPMKEISKFLIVMAMLAIGLNSDIVKLVRTGGKPLLLGASCWIAITIVSLILQHLLGIW

SEQ ID NO: 467 - protein, 522 aa, Methanobrevibacter ruminantium; identical to SEQ ID NO: 289

SEQ ID NO: 468 - protein, 222 aa, Methanobrevibacter ruminantium
MLKILAADKMDKKLIVRYIMLIVGVIIMSMGIALSIKATLGTSPISSVPAVLSIAFPWTVGEFTIVFNALLVIFQMVLLRKITISQIAQMLVCVLFGYMIDFSLLILNFPNPTDYISQWILCIISCFVLAFGLLIEVKSDITMLPGDGSVVAIAEVTNRDFGQIKPFFDLTIVSIAAILALVFLGHLEGVREGTIFAAIVVGLIIQFYDRIFGYNIDAYLAD

SEQ ID NO: 469 - protein, 393 aa, Methanobrevibacter ruminantium
MNLENKSIDLLNPFIIIAMVIVFIIIALPMWYAYQKLPSPSMDLFLYIGLGLIFFIFGILISNLLLNRFLKKDLSLDSLKDTIKISISKNPKKLSIFESYSRKEMILVIMVLIGIILQIINIVRLGGIPLFSATLKAEAAGKIWLASYIIFLPFINILLAEFNRDSHYLLVFLGLLLFTLTGYRTTPIAIVLSILITLYYTRNIKFKYQVLFLGLFLVIAVALLLAIGFIAVQAISWQHWSLNPIELVSYRAAFTLNVLGHAISNQFATAGKLFYSTLTGFFTHTDPRVLVGQATLGRNHSITSTIFGPALLDFGLIGMCIQMLLIGFILKTLHSIQKHKKEVYSAFYGILLAQTIIWIETGPTDVVVWIFYLIAIVLMALFFLKGSSRDLEA

SEQ ID NO: 470 - protein, 263 aa, Methanobrevibacter ruminantium
MATVDSFLPDFIQTTFFSGYTIFNTVIYTLILLIFIIAIIKMFKKIKIDPISIIYPIIPYIFLGSLIRALVDNGVYPKTVFLITPGLYILVGLITIASLLFSLFLYNRKNIDYRYTLSIIGVILLIPNIIMIPRLNIIPVIYVLITWIIASSIFVLISYIIPFFKDRINLSIISAHMFDASTTFVAVEFFNYSEQHVLANTLYQLFDTSITMFPMKIIVIVAVLYIIDQYFDDETIKSLLKLTVFVLGLAPGLRNFLTMAIGV

SEQ ID NO: 471 - protein, 501 aa, Methanobrevibacter ruminantium
MSNNQISGCSYALYLDGSDNGSFIGNKIFNNDYGILAKYSNINLFKNNSVFNNWIAIEDSSKYNQFLSNNIHDNYQGIRLIASNSALIENTNVYNNYLGILKYSSSFINKSASVYNNTLINVQSLNDGEIVIQDNMWYCGPAALSIIFESLGLSLSQEDIAKIAGTNTNGTSLYGLYQACIKKGFNPSVLKINSSDLMTNDLAVLLINEDYHFSVIYSINDTDIVLNDPSIGLFVLSRETFDEMFSGYVLDVEPIKDRVSNVSIAKMKTIVGTVFPALAYGGYLALAGVTVIAGSLAIVWNSNSHYNSKSIQKPHYTWKPNNKIHFPRNVKYPTSTGNNGNRPKVSYNPVTSSISGNKYYTNNKVYTYNYKSSNRKVSSSNAAIIAYQEAYNYYLSTKNNERAKVEKPTNITSYNYFLKDVKAFEKGSYKFSLGPKGPDDDLYDSAKIVKALYRDATRNYNYGKFLINTGNKSRGICYIFLATFEISFIPAIIYNQLSLNP

SEQ ID NO: 472 - protein, 264 aa, Methanobrevibacter ruminantium
MVKCSKCGSENKSEAKFCHSCGAKLDIKDPYNLDGKSREYGSTTGKSAGSASAYYDHSANSGGSSSDSTGGIDNFRNMSNFKKIIFACCAVFIVLFILSLAAQALGFDMEPYSENKTAYHNYSSLDLDDDGALCLEELEIEYSNISSSKMSDIFKKSDKNRNHLIRGAEYDMLNYYVNEHFKDLEKKKNEKTSSSSSSSSSSSGSSSYKSPFTTSGSSDDGAETCPFCGSEAVYESGNSYKCAECGRTISNPDDLDLNYDEGYY

SEQ ID NO: 473 - protein, 408 aa, Methanobrevibacter ruminantium
MKKCSKCGSENPDNAKFCHNCGSKDFGTNENICPKCGESNVKEAKFCHKCGASLSSNSSSGSSSSYNPTGMNGPFGAGANDKPGSVMNGPFGAGANDKPGSVMNGPFGAGANGVADSFAFDPSSNDKSSSSSNSNSSSNSNSSSNYSSSSNSNSSSNSNSSSNSNSSSNSNSSSNNQGSTASSANQSNSTASTKNQSNSTISSTTANTGNEGPGLKKICCCYVPVILLVLFIIFAILLNAFPENFSATYDDEFYQLDIDGDGRLSLSEASQLNPGMSDSSISSYFNEADKNNNGYLIGHEFDDFYSDVKPYSSSSSSSSSSNSHKYSSSSSSSSSSSSSSSSDYDSSSDGYVLTCPYCGSEAIYESGSYYKCADCGSIIHNPDDLELNYQEGYMDLLAPIVQINLGGV

SEQ ID NO: 474 - protein, 545 aa, Methanobrevibacter ruminantium; identical to SEQ ID NO: 290

SEQ ID NO: 475 - protein, 104 aa, Methanobrevibacter ruminantium
MIALVLAPTVLSLFTSSVTAAALVIVGILMIVQLKEVDWDNMVVAASVFMTIIMMLLTYSISLGIAWGFVTYAVAAIATGKAKEFSWIMWLMVIIFAAYVFFGL

SEQ ID NO: 476 - protein, 331 aa, Methanobrevibacter ruminantium
MLNKFFKLDENNTDIKTEFLAGLTTFLAMAYILGVNPTMLAEGGMPATGVFFATALASGVSCIIMGLVSKYPVGLAPGMGMNALFTYTIILAMGNTWETALAAVFVSSIIFLLITISGLREAILNALPFDLKLAIGAGIGFFLAFIGLKGAGIIVADPATLVGMGTILSAPALLAVIGILLTLILYIKKVPAAVFLGLVITAILGVIFTLFGFGAGDPLMPAIPTEFISFNFDTSVVGAFLKGFSQLFTNIPNLIMILFSLLFVTFFDTTGTLIPLANQCGFVDEEGKADGIDKAFLGDAISGIIGAILGTSTLTAYVESATVLVLVVEQV

SEQ ID NO: 477 - protein, 349 aa, Methanobrevibacter ruminantium
MERVRLQYIDLLKFFAIFSIIALHVFLVWPKAKVMGIKVYSLSSIVRFGVPVFIMISGALLLNRDIEIGSFLKKRINRITYPFLFFYIITFIFIALTNHTHEQQNIFAFRWYFWTILGVYLSIPIINKYIQHSSLKEIEYFIYIFIFASIFYQFTYFFEIKQYFYLTLFLSPLGYLVLGYYLSKKDFNLSTSKMIVISIILFILSTSIKICGQLGYIPITENFVASQSVILSSWLDVSFIGILQAASFFLLCKSIYEASKGIFSPIKKFLESNIISKFVLSVSRASYGMYLINLIPTVIVYYYIQPMNLTGSQVFLAIPLISIIIFLVSWIIIVILCKIPYIKYVSGYS

SEQ ID NO: 478 - protein, 212 aa, Methanobrevibacter ruminantium
MILGTYLIMPIFNRWIKDCSIREVEYFLAIWLITCIFDNTLLIGFPVTLTYFTGPIGMVVLGYYLRHTDRKIFNSLPYALAFLLIGMIVIMLCSYFLSSPEGMYVFDRYSILLAIEVVGIFTLYKVIDKKELKIFHKENGFFRRASFSIAKYSYGIYLCHEFIMNIFIIIFLKHAPFKVTLLLVFVCTLGTSWALLALLNRVPYLNRIIGAK

SEQ ID NO: 479 - protein, 483 aa, Methanobrevibacter ruminantium
MDNQNQWNSRIAFLLSMIGAAVGLGNIWRYSYVVYSNGGGTFFIPYLVAILIMGIPFLVLEYGIGFRHKDSFSNILKSINPKLEYISWALVLIIYFVLIYYLVIVSWDLVYLGSSINFSWGADSALYFVQNVGGSSNLSNMASFIIPTTISMVLVWICVWYISHKDLNEGIGKASKILIPLLFGIMAFIIVFALTLPGAGIGISALLNPDWQMLLNVNIWLAAFSQIIFSLSMGESISLTYASYLPEGSKLTDNVLIVVFANCAFEVCTAFGIFSILGYMSYTSGTPIVELVSEGTGLVFVVFPMIFNIMGAIGHIIAPLLFIAILFAGITSAVAVFEPMINSTVHKLNWSRKKAVTVWSIVGCIVSLLFTTGISSYLVGIVDSFITEFCILLLIAIQSIIFTWFYDIEGVIPILNENDRVKVGKTWVFVLKYILPILLFFMWASGVYHLLLNANTFELIVYGLITVFIIILTYVFTNIPEKS

SEQ ID NO: 480 - protein, 385 aa, Methanobrevibacter ruminantium
MTIKKYFKTRKGTKKSVQERDYDSDYSNKGLHKESRIKNLLNDNKGNYSIVISAILLISFLILSIIVLNTVLEEREEHTDTIASNQYQYIIEDYKRNLPNIEREALEELSLYVIENKRPCFNSRDDLKEIIDEKLAQKNQEYYQNYNIEINSSIIGIENTSDPFSYKFKTYISSVKGDFSYEEIDESYVNCYNLKDPVPVLFCGDDSSFRIEDYSLLGDSDFGTHDSNFENDDSSSNQKVFYGHSLAKFLRRHHVENYSFYENASSPFIIKRCPYDPYKHHGDDNGRIMKNCRDNGYYHESADGACYLCRLEGKSGCDHYGFETFINPQKTNETGGVSACGSDHVIFSDDIYPGVEVIYNSENGLNEILYLDPHGHKVKYGMSEY

SEQ ID NO: 481 - protein, 356 aa, Methanobrevibacter ruminantium
MIEMIKLVNELKIDQKGLMYSSELILSLILIIFIIGIMANITDSVNEKVLSQEELSSLEAISIESVDYLLNNPGSPMNWEEDEGLNNGIVSRRIIPGLAINKKSVENGFFYEESSSDEEIIPNSISYIKLLKLQSNYDDLINRNLFNSTLKSSITIYPHSDIDIIAMGDDLESSSDVVAINRTVRCDYLSNFVIYRFNDFELYGENYKKTELCNHDSNVNLSNHSNDRRYFWLCKNFRIYRSSLNNYNYYLISDSSIRHANSYYILESLNRTRDDMERLNDEVIELNPFFAEDMVNSSNEIYSIHFKVPHDDIDDFKTVMVAIHKNMTDEIVSNNQLRYDYFNSGEVDFVLKTAYR

SEQ ID NO: 482 - protein, 762 aa, Methanobrevibacter ruminantium
MLVKKMLRDLSDHKIQFVSIFLMAFLGVFAFTGINGEVVGITDVSTHYYEDTNLADGWIYGENFDKDTLKDIKNMEEVKNAHREMVVDTVANYSSDPDITLHILEGKQEISKFHLFKGKDFNPNDKEGIWIDKRFADARDLDIGDKISLKFDGKTVSKTIRGIIYSPEYVYYIQEGSMIPDFSQVGYAFMPSKGADFDIEYNRITIDGKKELDAKEFSSEVSELLGQYTYAQFVPREDNVGVSTLQDEIDQHNMFSGIFPIIFVMVALLTLLTTMSRVISSQRTQIGTLKAMGYDNTTIILHYLSYGFFLSFAGSLLGLIIGPLTLPYLFYPSMSAMYSLPYWGPAWNLSFFLVAALMVIISVLVTFISVKTINDENPADSIKPKVPKAVSSGIMERTKIWKKMGFNGRWNYRDAKRNKVRAIMSIFGVFACALLIMSAFGMYDSMNDVQDWQYNQIYNYNSKLYLDENITDAQLSTVVKDTNGEEMMEQAIEVKYRGNKHTASMTVYNDSELFRPTDINRNYIEIDPDGVAISDRLAEVLGLKVGDKVRWHLVGNPKWIDSEITQTYSTPFGQGIIMSEKTYEKYGGDDYNYSTNVVLTEDKDIKNYTGVTSVSTREDIVKGWEDMTEAMNLMVYVLIIFAVILAVVVLYNLGLLSFTEIQREIATLKVLGFNTKSLRRLLLTQNLWFSTIGFILAIPGAYILMEAMMGSTGADYYFPINIYPLNFIISLIMTFGLSILVNLLFSRKIKKVNMVESLKSNE

SEQ ID NO: 483 - protein, 443 aa, Methanobrevibacter ruminantium
MKMIRQFGESSIALVVNLILFLFNGIKYIFTLPNRIYVYIKLFLEDTDAVLKESLIALSICAVGDLCAGIILGNMEFFLKTYPGLMVIIPGAIGMRGNIFGSFGSRLSTHLHIGTLSPEFKRSEILSENITASLILTMVLSILLAVIAKGVCIAFGFKSISIYDFVLISFIAGLISTIIMLPITMFISLKSFEGGWDPDNITTPFIAAVGDFFTLPAIILSVIIVGFISIIPIVKMIVFVAVIFVTIAALIAGYTAKSDVRHIVRQSTPVLFICSLLGTFAGGILNDSLTTLLKNQTLLTLVPLFSGESGGLVSILGARLSSGLHSGLIDPVLRPKKHTVENFVAILTLSVVMYPVIGFLAESSTIAFGNIGVGILESMSISFLAGMILILLMLLVVFYISTISYRRGLDPDNIVIPLSTSLTDSISTLILIVVSLGLLNYVF

SEQ ID NO: 484 - protein, 330 aa, Methanobrevibacter ruminantium
MLLTILLFSLAVDLLLGEFPMQIHPVVWIGKIISFFKNILIKYDNKIAGLILSIAVIIVSSLIVLIPMAIARYLLPYNDMMIYLFKLIAILLLTSTFSVKLLLDSARDVEKDLRNNNLNKARQAVSYLVSRDTNELNKEHVISAVIETLSENIPDSYVSTVFYYSIVGIIASLCGIGDFDVIILAVLAAFIHRVVDTMDSMVGYKTKELYNIGFIPAHLDDALNYIPARFSGALIVVSAMFLRLNWKNALFIMRRDANNCDSPNSGYTMATVAGALNIQLEKEGVYTLGDNINPINVDCIEKAVDLARLTIFLVTIFFMFVFMDLILLML

SEQ ID NO: 485 - protein, 755 aa, Methanobrevibacter ruminantium
MLKRKMLRDIWNYKVQFISIFIIAFIGVFVFAGLTAEADGFEASIDSFYQRSNLADGWIYSNYLVDDFLKQVYLLGATTSMERQLVVDSQAELDGKPDITLHFVENNTISKYYPLEGNELNISDSEGVWLDKTFADARNLKIGDTIAFESNGIKIEKKIRGLGYSPENVYSLVPTQTVPNYTARGFAYMSYKAFPSDNITYNVLNVKFDGRPEIFSELLSYRLDGYYELYLPQSNQYSVNAVSDSIAHQSSLNAVFPILFTLISMLMLSVTMKRIISNQRTQIGVLKANGFSNRSIAIHYMSFGFLLVTSGSILGAILGPIVFHFVVHESRIYYFKFPVWAYVGLERFIFVIVIISLISLIVSYLSIKSIVNEPPSQIIKPKPPKMVSSGFIEKLAIWKRLSFNIRWNYRDIKRNRFKSLMTIVGVMGCTILLISGFAVYEQMEISKDWYFNDVNHFESKLVIDDNTDLSQIDSIAHKVNGDEIMESSIEILKGDANFASLLVLNDTDLITMTNDNREKIDIPKNEVSISKKMADILDLKVGDTIDCHLLDSNKLVKIRIDRIHSTPFTQGLVMSADKYEELGFNFTPTSIITSEHVNKSYDGVKSTIYSEDMVRGWDQMQKTSMMIITSILFLAIVLAVVILYNMNLLSFIEMENDIATLKVLGFKSKYLTKLLATQGFFFIIVGFILGLPVAYYILTLLMPAFGNKIYLIPNISVLNMAFSFLIIVSVFIVMNLYFSRKIRKLDMVDALKTFE

SEQ ID NO: 486 - protein, 483 aa, Methanobrevibacter ruminantium
MNQNAQWNSIITFILAMIGLTIGIGNIWRFSYVLYSNGGGSFFIPYFIAIMVMGIPFLILEYGLGFSLKKSFSKLMHDIRPEFEVIAWMLVIFVFIVVIYYMVIIGWDFVYFLNSFSFGWGSDPNSFFMTYVGGTREISQIGRLLLPTLICTTVLWIIFWFVSNRDVDEGIGKISTILMPLLFIIMIFIFLYSFTLPGFDIGIKTLLKPNWSLLLDIHIWLAAFGQTIFTLSIGQAMVYTYASYLPRNSKLVDEVLLVVITNTLYEVFIAIGVFSILGYMSLKSSIPIEKLISEGTGLIFVVFPKIFSEMGFVGQIIGPLLFLSILFAGFTSALALFEPFLSSLCDKFNLSRRKGVTILVIVAVICSIPFSTGISSYLVGIVDKFVNDFGILILIGVQAIIFGWFYGVEKVMPVLNELSTFKVGKSWVFTIKYLLPVLIIIIWVNGVVGLFSNTNSFELIVDLIITFVVVGFSVLFTKLGVKE

SEQ ID NO: 487 - protein, 168 aa, Methanobrevibacter ruminantium
MNKKLIEYLIIATVIILILYGCYSLIDYQSNGYQFRMVNATDSMNISCPSSSAYSVSGDTVEFRNGLNSFYNMDVSKLNSSDGKVKNILNQYSKFHKSGTLDLKNETCYVLTVELEDDKGFNYHSMIISVDSFDKDSLSFNKEATVYLFDGNNREFVVDTVYGSQVVI

SEQ ID NO: 488 - protein, 312 aa, Methanobrevibacter ruminantium
MSPYELIKDDGEVVNLGGSPDESQDFDVSLERLNDKSLADSDGDGKHDVFISYSTKNSDIANEICYLLEKNGLECWIAPRNISSGKNYVDEIADGIKSTKIVVLVFSKYSQESKYVNNEVMMAFSYNKPIISFNIDQTEPNDIMGYYLKVAQWLPAYPNPKSQYETLVTDALKLCNERPRTVITSLDGFIPEDISKQKKNWISLILLFTPIYWASFIYMGLVSKKKSWTLLGFLYAIPTVIGLLLYFQVFTRLFLIYPIFRLFNLIFILCWILAIIHGLVIRNEFLTRYSVLGLMSFDKDLFEYLYGMYYKM

SEQ ID NO: 489 - protein, 291 aa, Methanobrevibacter ruminantium
MSHDVFICYDEEDKDCAEAICRIFEENNIKTWIRSRDVSSKDAARNLTEAIRNSKCFVLVYSKNGKNTNYIINETDIAFSKEIPIILFKLDETSIPKDLEFILISKKKIVAYPHSKRQLKTLVKETSDILDRPTDDIKLDSNSVKTIERSNPKRKENNIKKAIGAAALIAAVLILIYLFVIVPTGQNITDSGVFSMDVTHVEVDELAKGNKYTIYGESYNLPSDSDRYFMNLQFFDDKDNVVYEVNSTADEFKSGIIWSGDINKGDIKHIGFKLTDMDNKILSQEDYNLGL

SEQ ID NO: 490 - protein, 269 aa, Methanobrevibacter ruminantium
MGLLSLTISYFNKSANGESLWAPFLEMFRMLSVVLILTYIATKSKSFKVIIRGQQSRKTIIWQIIIFSILGILASYCTMDVNGIPANARGLIVMISALLGGPYVGIPVGIIAGVWRYGMGGITALACGVATIMAGIVGSLVYRWNDGEFLRPYKAALLMLLYSGFDMFLITILTPQPKGVLIANALYAPMTFGAVLGILLFTLFLTEKKEEAEKSDEQTVSDNRNTDTQNINEISQELNEYKDKVKKLEQKLEEYDKKFNQLEQKLKDK

SEQ ID NO: 491 - protein, 476 aa, Methanobrevibacter ruminantium
MNETIKEHSWIPLILVCFATFIIALDTTFMNVSISSVVADLNTDVSTIQTISSFYTLITASFMLLSTKLQDIVGKKKLFLIGAGIYGVGTLTAALSANTLMLFIGWALLEGIGGALMTPTAVSIISGTYQGEKLTFALAIESALVAIAAAIGPLFGGVVTTYFTWRLGFAVEFIIVLIVFALQGKIPYFEATGSKSELDITGAIISFVGLVLFVMGILMLTDDTTFSIAIMAAGLIVLALFALFEIKRKRKGNVPLLDVELLKDRNLRVGTLLRLLVNLAMGGALFAVSVYLQSVLALSAFNTGLTLLPMTLGLLLFALTAPKLSAKLNHKILMSIGCIISIIGCLILSQQFTMATSMLELMPGLFVLGAGLGFVMALGVDIALSNIPQEGQNNASGIVTTGQTLGQSMGTAIIGVILILGIIGGISNAVDTYVPDQSGNATFEHDVYEGFQSISSINDVKAENSTIQNIVKLSIG

SEQ ID NO: 492 - protein, 224 aa, Methanobrevibacter ruminantium
MKEDTASNEEIRSRLLDGGKITGTNMRVLVCAMVIASVGLNMSSTAVIIGAMLISPLMGSILASAYASVTNDRPLLGKHLTGFAMQIIISVTAAAIFFFLSPVKEPTVELLARTSPSFYDVLIAFFGGLAGIIGQTRSDKVSTVIPGVAIATALMPPLCTCGYSIANGRWDMLLGAGYLFLINCYFIFLSSSLILSALKIPKLKEYTEKEWKIHKWRMSYGILF

SEQ ID NO: 493 - protein, 477 aa, Methanobrevibacter ruminantium
MRDIEELKKTPGLSLKRYLILFIANLIGLYLISFGLDFTVTNLGRVIIFIFFISIFNAAIWPLVTRIYMPLMVWTFGIGALLLNGGVFAFFGPYFGLDISGWGIVLAPLTIALITIVLSTLMDAEDDGTYYQAVLREAQTKRKGEIKDYPGLIIVEIDGLAYDVLLEAVEKGVMPTVKSMIDNKTHILKKWETDLSSQTGASQAGILHGNNENITAFRWIEKENNNQMMQCSGVTKVKVLEERISDGNGLLVENGASRSNLFSGDTDNVIFTFSKITDLRKLYNGAWFSIFSNPSEFARIVILVIEDMVHEIYSQLKHSILNIRPRISRGIAYIPTRAGTNVFMREINTETLIGDMLIGDIDVAYSTYLGYDEIAHHSGVRDEDVWFALKGMDKQIRRLIYGNKYSPREYEFVIQSDHGQTNGATFKQRYGQSFEDFVKSLLPHETNIYAKMSSNEDHFAEVYIPFKDRIDKFKNRN

SEQ ID NO: 494 - protein, 591 aa, Methanobrevibacter ruminantium
MLAPDLGLIYVLGLLFGPYGALGVALAIVTLNLINGFTLMETLPFEIFTFGVSYLGYRLWYSGFKTDTITKPKLDNSYHISLFLVSIIICGFIYSTVQGISFNLIFWVDRFYIMILFYFMSFTTMAFLYGIIGIWICNRYDCFETPKKSKRHVDKRIYQAIFCMIIITSIILATSFITTDDTTVRIIELIVLGIFLFAYLTKPFEYDITPNDKDTISGRIMRNFIIITFILGVLGIAISMISYSAYSQSDNVYLVLMWGPIITDTVLLLFLIPCIFILRYIEDKVVQPISSFSKIEGFIKENEKIDEDGLVKTYSKYTDEKTEIGTLARSYTELIKHNNNYIENIREIEGEKERINAELDIATKIQESSLPENPIKTNDFTVEGYSIPAKEVGGDFFDYYMVDDENLAIVIGDASGKGIPAAILSMITQFMIKNFLKQTLNPSEVLYSLNNQLSENNPECMFITLWLGIYNTRTKKVRFANGGHNPPLVKEDKKFKYLDIDTGLVLGITGDFDYINEEIILKDELIVYTDGITDATDEDSNIYGEDRLLKFLNEFKGDEVPIKPLISDVNTFSKGVEQFDDMTLLCLKLNK

SEQ ID NO: 495 - protein, 462 aa, Methanobrevibacter ruminantium
MAGNICLFVDGLIVSFLIGASNLAPIQIVAPVITFVNLIYWMIGLGGSVLCSVAKAEFDDEKSNSYFSVSIISLISIGVLITVIGLLFSGSIAQFLCSSQPELVSQVSQYFIALVIGMPFLCYMMSLSYFIRADGIPQLPFRAILIANIVNICFDIIYIKFFNLGLTGAALATSTGYLVGSILISYYFFKKERTLEFIKLKANAFFKFIKKIVTSGFSSASTQLYLTLKLLVINFLVGLYVGKSGVVAFGICYNSLFILYIFLIGTAQTMSPIVSVYFKEEDYSGVDYIIKRSLKIVVASSLALSVLFIFYPQALLFLYSVKDPADVPVVLNALRIFAISYVGTAITFLYTFYAQAIQKNRLSTIISLLEGFLLPISAAVILSFAIGGNGIWISFAIAELLTILFIFAYSRNINKKTNGEYTGFFINKHNDDERVFEYTINGNIEEAVNLLQRKSQKLPYLG

SEQ ID NO: 496 - protein, 353 aa, Methanobrevibacter ruminantium
MFNNYKDKLTGDRKILILFVILAIFNIALYINIFKYMVDIKDINMAVIHDFVTINCAIIILGFTSTRLPNLKKRDSSIYEISYLIIIGLLSITISFFNKSINGESLWAPYLEMFRILSVVLILTFLATKTKSFKAVVRGDRSRKTIISQIILCSVLGILASYFTMDINGLPANARALVVMISGLLGGPYIGIPVGIISGVWRYSMGGPTALACAIATILAGITGSIIHRWNGNEFISPVKAGLLMFFYSGFEMFLLTILTPRPTGLIVASNLYGPMTFAAVLGILLFSLFLDEKKEKAETDTDDGDEDKKIELMSEELEEYKIKANQTEGELKEYKDKVEKLEQELNEIKGKI

SEQ ID NO: 497 - protein, 202 aa, Methanobrevibacter ruminantium
METKNLIIICVTLIILVCLGLFLISHMNGQEETHITILTSQYLTEGDTLKLKLCDKDGKGIADQKISLKIQSKDGNFNDDIVIKTDENGESQIQNLQRGNYTLIAKYDGTSQYEGYGLTYEFIVSPKEVEQSSKTTSTTTTATSNNGDYASDYKADDVIDGWDPSEHEVSREYLGEGEYRVNYDDGYSRVIDSDGNVLSYGY

SEQ ID NO: 498 - protein, 36 aa, Methanobrevibacter ruminantium
MLYRGYKKGMEFGKFQYAFIVCLSALFICLLYSLFN

SEQ ID NO: 499 - protein, 236 aa, Methanobrevibacter ruminantium
MLKKLKIIIVGDRMDNKLFLQAFSKFFIGLIIICALLFIPAGTLNYPNGWLFIALLFIPMFFAGIIMFIKSPELLRRRLNADEEEEEQKIVILISAIIFLLAFILAGLNFRFGWFKLNSLIIIIASVIFLLAYIMYAEVLRENEYLSRTVEVNEGQNVVDTGLYGIVRHPMYTSTIFLFLSMPLVLDSIFSFIVMLIYPIIIIFRIKNEEKLLEEELDGYVEYEKRVKYRLIPYLW

SEQ ID NO: 500 - protein, 327 aa, Methanobrevibacter ruminantium; identical to SEQ ID NO: 303

SEQ ID NO: 501 - protein, 298 aa, Methanobrevibacter ruminantium; identical to SEQ ID NO: 304

SEQ ID NO: 502 - protein, 466 aa, Methanobrevibacter ruminantium; identical to SEQ ID NO: 305

SEQ ID NO: 503 - protein, 305 aa, Methanobrevibacter ruminantium
MLIAMDFRIIILSIIIMILLGVLLKKIDLLKEEDVETLNNLVINICLPCLIFNALYTADVSLLPSLSILTLSTTITSLIVGVFTYILLKLFAWDNVKIWSILVTVVLGNTGFLGYPITQGIYGSEGLIRAVFCDCSTSITFVILSVILILIFDGELKVALRKIATFVPLWSIVLGILFNIFAIPITDVGTTVVGYLGDATIPLIMISLGLSLNISGLKNNLKEVSLASFIKLILYPFVALGVMALLGITGFNHTIGLIEAAMSSAMIGLVLAITYKLDPHLTSDCIFTSTLFGLVTIPLFLMFIV

SEQ ID NO: 504 - protein, 385 aa, Methanobrevibacter ruminantium
MNGIYYYVIAFLLIWTIAIVFKGRLENYGLEVNFPLLMWKTQRLRGFIDRIANRAPRFWKWYMNIGIVISTGFMILMAVALVYSLKTLMDAPTVSLVIPGVEVPGSPIFIPFLSGLIALATVLIVHEFSHGILARVEKIKINSIGLLLFAILPGAFVEPDEEELKGLNRPSRMRIYVAGSMANLTLAAIALVIMMLISSFVVPAVFEDDGIVISRLTEDGNAINYLSEGMVIKGINNYSVSDGASYQKAVSTLRPNQTVTVLTDQGEYSFQLKSNPQNKSLGYMGVQAQVNQIISPDFDNKFYTPLLWGIMSLTDLLFWIYFLNFAVGTFNLLPMKPLDGGHLFEDLLSYITSENIYKPVVTFMSFFMGIIIVVSLVVGFVGVPF

SEQ ID NO: 505 - protein, 463 aa, Methanobrevibacter ruminantium
MKFDSETSVLLVSFLTAFFAVFLAAGIVIGVPAIANEFGMNNVVQNWIITIALLVVAMFTLPAGQLSGKFGVKRSLLVGVLIFIVGSIGACLAFSAESFLFFRVIQGIGGAFSNVASMAMVVQAIKPQSRGKALGLTVTGVYLAGSLSPVICGFLVYNFGWRSMFYFTIPFFLICIALMLWKIPGDWKTYENDKIDSIGYMIYAVGILLFIYGFTNLINAWGLICVVVGFILLLAFAYYETRVDTPAFNMRLFKNTKFASSNVAALCSYLAVAALTTILNYHFQYVRGWNAQMSGLILIVTPIIMAFMAPNSGKLSDRIHPQKLAAIGMTIATAALVILIFLDANTPIWLIIVAMVLQGVGMGLFTTPNTNAIMSSVPPKETPNASAAQSAMRTIGQTMSLGLLTLVFAWIMGSLKLSSQYAGMVVQASQIVCIICTIICVVAIFASLVGIKSKDEFNIEKPS

SEQ ID NO: 506 - protein, 463 aa, Methanobrevibacter ruminantium
MKLDLETVVVAVSFITSFFAVFLSNGIVIGVPAIAQEFAMNNVIQNWVPTIFFLVVAIFTVPAGQISGKFGVKKSLLGGVLVYLFASIGAVLSFSTESFLLFRILQGAGVAFLNVSAMAMVVHAVKPQNRGKALGFTVTGVYLATSLSPVICGFLVHNLGWRSMFYFVIPFLVICVLLMAFKIPGEWKTYEKDKIDMIGSILYGIGILAFIYGFTTLTTSTGLILTIAGLAMLVVFGAYELRQKSPVFNMNLFKNKKFTSSNIAALCSYIAVMVVTTILNYHFQYVRGWNAQTAGMILIITPIIMAIMAPNSGKLSDKIHPQKLAAIGMSIATVALLILTFLDGNTPIYFVILAMILQGIGMGLFSSPNMNAIMSSVPPKDAPTASASQATMRTIGQTMSLGLLTLVFAWVMGSLPLATKYAGMVVQASQIICGICTVACILAIFASLVGVKSKDKFNTDRPT

SEQ ID NO: 507 - protein, 285 aa, Methanobrevibacter ruminantium
MLFVEILKNLSVFEILVRKLLKKVKNTRGLVLFLVFTCFFSSIFITNDVSLIIFVPFTILALRKVDRLDLIIFAVSMETIAANVGCMVLPIGAPHNIVMYMVSHIPFQSFFLILLPYIVVSAVFLIILSFFVPSDAVNLPKFGKVEINKEGFFKRVLFGVDYFLLLTFIALFVLIGNLENITFFNLLFKKWIIGNEVIWGVVASQFISNVPAAILLSGFSTNYEAIIVGINIGGLGTLIASMANLISYKILVREHGEFKIRYLIIFTFLNVVLLFILLGVYVFIH

SEQ ID NO: 508 - protein, 83 aa, Methanobrevibacter ruminantium
MWLIIFGNIENLILSSQGVVQGVDPKILGGLSILVVIMWFVIGTVITDVAIQYSNLINFIGGLAIFLLGFQAVYEAVRNIRGG

SEQ ID NO: 509 - protein, 89 aa, Methanobrevibacter ruminantium
MDWKPYAPFTALLIFGNIENLILSSEGVIAGVNSFVLLILSLIAVVAWLLLGTYGTNYAIKYADYIEIIGGIAIILLGLESMLEAFGIL

SEQ ID NO: 510 - protein, 214 aa, Methanobrevibacter ruminantium
MEIKRINRYVIYLFSLFLISLGASISIKANLGTSPIICLPYVSSLILNMSVGTVCLIFNVIFILVQIILLRGDFERRQYLQIIVGTIFSLSIDFSMTLVTFLNPTNYISQFAVLMLSCVVVAFGVLLEVQTEVVFLPPDGIIVAISKVLNKEFPKVKPFFDTSLVLTAAILSIVFLGYLAGVREGTIISAVIIGPIVKVLQKFFNPYIEAVIEK

SEQ ID NO: 511 - protein, 153 aa, Methanobrevibacter ruminantium
MNFEFSILGLFLLLLLFVPNIIWTKFIPKDYENYSKRENKILLILERIGEVATVVFALFCGAKFSWSLLLIIIFILMALYEVYWIRYFMSSHTMKDMCDSLLMIPLPGATLPVIAFFLFGIYSNSIFLVISSIILAIGHIGIHYNHKKQCNLN

SEQ ID NO: 512 - protein, 539 aa, Methanobrevibacter ruminantium
MSNSQNDGLEDVSKGNNESAGENTDSTSNKKTRFTKSKSISEVFKELDSQETNDSILDSEDAASELESEDKYSNIENYLSEAESEEEILDASSEAESLDASSDVEFEEDIIIDSTAEEEIDEIIPIHNEYKDLDESEAFNTESIDEEEISESSELDNYVESIVNEKDDLSSDELVDSKENLDAVGGDEGSMSVKDIENASFEAEDTSLDAEDYEDDSIDSEDIDQSYEEELLDENMKVIKVNNASSEDVLSKKNKGFLSSFGSIKMDSSFIITVLSFIVGLGILIMGIFYLNSSSDRVVDNVLSGETAGLAVFLIIIGLLIIGFSILRFLSSTKADQSSSMLDMFKSIRDIDYDDVKDDNISRDDFDSVFSSVFGKEKRSDFSNDDGDKSSVDKNLFDEDDEISDEDIDALYSDSNLNKTASSTKNSTGIQDTDNIIEEDLDDDFDMIDSDNSEDFDNDTDLEDDNVSDLKDKYSKYNFDDDDAPSKPQFKKSVDISKFDDDGLSEEELEAERRRKAEELEEKKRRIIQGTNFDNSLRK

SEQ ID NO: 513 - protein, 205 aa, Methanobrevibacter ruminantium
MEIMPIISFFIGVISILSPCILPTLPIIAGFSLKAESKAEIVAFILGLFSIFTIIIFLTGFFTTILFRYIVYVRVIAAFLLLIMGILMFFDYNLSFGSVKSRSGEGIVNSFILGFLTSVAWADCYSGYLISLITMLVSSSPLYAVFNIFIYVFGFALTLLVLCLAISKIDLEKLIYKSGYIPKIFAVLIIIGAFYMFYTSIQVFL

SEQ ID NO: 514 - protein, 447 aa, Methanobrevibacter ruminantium
MERIIGVDETAKTPAYELEDGVDYVPMNKYRALLVHFLNIAGLGPIFGAIQGALFGPSAFLWIVLGTIFAGGVHDFFEGAMSVRNDGLSMPGIISKYLGDRVRKFFAVLIIITCILVASVFASGSADLLSSLTNIDIHIWLVAIFIYFLIATLFPVDKIIGKIYPIFGALFFIMAVLLISALILNPNYSLPEFTTAGLYLTDKAIFPFLFVTIACGAISGFHASQAPIVARCVKNEKDMHMVFYGAMVIEGILALIWATIAMSFFHGQPQLASIYGSSPSIAVKEMSIALIGTVGLVLAIIGVVICPITSGDTSLRSARITIADELGLNQDKLKTRLKISIPLFLVSFGLTFIDFSLVWRYFAWSQLIVAIAVLLAATVYLIDNKKHFIVTFAPAIFCTVVAIAYILQASEGLRLDPFISNVISVIVALALSVYFILKYRKQPNTTT

SEQ ID NO: 515 - protein, 153 aa, Methanobrevibacter ruminantium
MLSLIKDNKGFLSLIDAILSIFLIFIVLISFNMIVDMEMPSLSEDNNQFKTSQDLMELMSSKIDGRDYSTLERISYVLSSNDNSIASRREVKNILDDFFSAHLGSDYKYVFIETNQLNGYVLSSDGDYSTADEVSLAIRNYGNYSYKLYIFKA

SEQ ID NO: 516 - protein, 401 aa, Methanobrevibacter ruminantium
MEERTGLFSNGVIWFGVAISVSEIEAGIQLASMNTLDSIWLPLVLGHIIGGILLFSTGLIGARLRLNAMETIKSTFGNYGSKFFSTLNVLQLIAWVAVLNAQGASALMGLNLPISFPLTCIILSAIIAVWVYVGLRRSSKITTIMMIVLTALLVILSVKLLGVHISNALPIQNINSTALSFWSIFEISIAMPISWLPVISDYTKDVENPVNGTLVSAIAYTIASLWMYFLGIEIVGIGTTSIAQSILLAGLGAQGVIILVLSTVTSNFVAANSAGESAKAIFNRINPKIAGVVVSAISAILAISGIMDHYIGFLYLIASVFAPMAAVLLVSFYLSKEETGNARIWYWNIFAWLAGFIVYQATVNLDSIFLGPTLLAVIVSAILAYIPILLKNKSKLPNISK

SEQ ID NO: 517 - protein, 280 aa, Methanobrevibacter ruminantium
MNETIKTLTIQDISCYGQCSITVALPVISAFGIETAILPSAVLSTHTSGFTDFTVRDLTEDLPEIRKHWEKEGIFFDSIYTGFIASAEQLDYIKDIIDSRLKENGLVFVDPAMADHGEFYNGFDQEFADKMGELCKLGDFILPNTTEACFILHKPWKESFTKEEMLEMAKELKAFTKRYVILKGYEEEDKMGMIVLDKIEDTIDIVYNEKINYVSHGTGDVFASSFVGSTMLGKSPSAAAKIAGEFTKKAIEKTIGDETHTYGVKFEQAIPELYDLLKSI

SEQ ID NO: 518 - protein, 225 aa, Methanobrevibacter ruminantium
MMDWSPIFISMKTASLSIFITFFLGLIVAWLLVKIKNDTTKIVLDGIFTLPIVLPPTVVGFFLLYIFGIRGPIGSFFLDFFAVKIAFSWPATVIAAVVMSFPLMYRSARGAFKQVDSNLLDAGRTLGMSEWKIFWKILFANALPGIISGGILAYARGLGEFGATAMLAGNIAGQTRTLPMAVYSEVAAGNMGTAFDYVIFIVAISFIAIFIMDYFSIRKENQWKN

SEQ ID NO: 519 - protein, 826 aa, Methanobrevibacter ruminantium
MAQKELDIPVDGMHCSSCSLLVEKSLGKLDEVESINVDLNTNKAHMVLKDNLSPETIDKTVESVGFTVPKEEVVIQIAGMHCASCVNNVEKFLPRVDGVVEANANLSNQKVTITYYRDMLNLKEIQKTIEMLGFEYIGLDGELDIMDEEERYQKDLRGKLYRIIVGLVFAGILMAIMHFHITIPPLTMGQLSLIIAIFPFCYVSMPILKAGWNSFKHKNLDMDVMYSMGILVAFVSSVLGTFNIILDSSFMFYESAVMLPSFLTIGRYLEARAKRKTSSSIKELIGLQPKTATLITSDEEGNSIEKEIDIEDINIGDILLVKPGEKIPADSIVVDGESYVDEAMITGEPVPKLKKEGIDVFSGTINQDGALKIEAQKIGSETVLSQIIQLVEKAQGSKPPVQRLANKIVSWFIPVILTIAIVVFCLWYFVAGAGLLFSLTCLISVLVVACPCSLGLATPTAVTVGVGRAAEYGILIKNGETLESSKDVDVCVFDKTGTITEGKPEVADIETFDMAGDKFLQVLSSVENNSNHPIAKSILNRFKSDNLKLTEEGKDDLALLEVSDFENITGKGLKANVVVDENNSSVLAGNLKLMESEGVEVTDEVLDKFNTFVSEAKTTIVMAIDGEIKGIITLMDKIKDNSKSAIDELHKMGIETYMLTGDNEKTASTVANEVGIDNVIANVLPNDKLDKVQELQKEGKRVLFVGDGINDAPALSQADVGVAMGNGTDIAMESGDIVIMEGDLENVVASIQFSKKVMTRIKENLFWAFAYNMLLVPAAAGLLFLLFGIVFKPEWAGLAMALSSVTVISLSLLLKRYVPPIKRNKV

SEQ ID NO: 520 - protein, 471 aa, Methanobrevibacter ruminantium
MIGIGAILLFPLPIDLFYREFNYVYGVIPPLISIILGVIFSQGFREYDKLKFKHGMIISSISWLWAGLVGAIIMMLILDVSFVDAFFENISAWTGSGLTMFSDVESLPMSILFLRSVEQWIGGLGVVIIFISLLIKPGTSAFKLYKSEAREDRIKPNIKNTLKKTMQIYAIYTVIGVILYLIAGLPLFDSINLTFTTISAGGMSIKNANIGFYQNDIVYIITIFLMILGATSFTVHYKMAKTKGKAILKDIQFQLLIVSIILSAIAIAIITKLAPMDVVFHVVSAITTTGANIAPPSEMAAWAPPALIIIIVLMLMGGSSGSTVGAIKLVRVITLLKSTHLAVTNIVSPGRFVKIKISGKSINEGEMKEASSYMAVYIFFLAISWIIMTYYTNDPFNTLFDVVSTLGNVGLSTGIISGELGTIPKVVLIFLMWLGRLEIIPILLTIQIGFETFNQSLRFVKRRMMRKIKPN

SEQ ID NO: 521 - protein, 439 aa, Methanobrevibacter ruminantium
MGSLDTGIIGPVLPSIEQSFHLTSRESSWIFTLFVITFMIGSPVMAKFSDFYGRKKIFILDVLLFGIGSCLIAASISIELIFLGRLIQGFGCGGIFPVAGAFVGDGFPLEERGKALGILGSVFGISAIGGPLVGAALIPYGWNWCFTINIPIAIFLIIFAWYILPDSDNDRKLKIDYLGILILSLLAIFLSYGLNQIDSSNFIASLLSLNVLPFLVIFIILIPIFLKVEKKAEESIVPIHMLKNKEISIACIETLCYGIIYSSAIFIPSLVILSMGLDDQLASLMLIPILGANAVAAPILGKILDKTGSKKLMAMGTMILAIGLIAIAIYPSNLIFFIIAGCLIGVGLVTIIGAPLRYIVLTEAKPYERGAGQAIVNMLSSAGQLIGGALIGGIIASFTGILGYQVSLIIAAIVALIAFAFTLRLKGRDEQIATMKANQ

SEQ ID NO: 522 - protein, 454 aa, Methanobrevibacter ruminantium
MANENVELMRGAPEIAVKKLAIPIMISMLLTASYNIIDGIFVAGLGQAAIAGIGFVTPIFMILNGVSVGLGSGATSSISRFVGAKNHEGANKSATHALLIFLIASIILTIIFLFIQEPLLRTYGASGQSLAEGLKYGSPLFLGLFTFMFANGGSGILRGEGDMKRAMYAVIVSVILNTCLDPIFIYTLGMGSAGASLATIVSSAGSAIVIMYWILIKKDTWVHVELKNFKFDSNIAKDILKVGIPASMDMFMMSLAVSLYLIFISTIGGEFGIAAFTSGQRLYLFAIMPLTSIGSAVAAVAGSAYGARNGDYLSRTHIYGAKFGIAFGTAVTIILIAFAPQLATIFAYTPETAPLVPEITQFLRIASLCLPLTGAGMCSSFLYQGIGKGTISLMWTIIREVIFTVSATYILGIVLGWGLVGIWTGLAIGRITASILNFTFARFTIKKIRENFGT

SEQ ID NO: 523 - protein, 363 aa, Methanobrevibacter ruminantium
MNISSLFSDEKVNTGRQVELDIAKAFAIIFMIFLHTVMIVEAYNVGLSPTYTYIIGNVLGRPYAAVVFMFCMGVGVVYSRHSQWNLMIKRGIILYLLGLLVNVFEFFLPHYLAGYLGVNAEAFPLFGGLIIFCVDILAFAGLAFILMGILRKFEVSNKAMIIIAVIMSLIGSFTIGIDFGIPAVCSFFGHFIGAKNGHTAFPLFNWFIFPVAGYVWGQYFIRAKDKREFFKYWPILLIVAFAYFFISSRYWGGVFSEDVHLYYFLNTLDAVFCIINAHAFIGLCYWISDYLPDSITKFFSTLSRNINEIYIAQWFYIPVTIILITYFSKGLVFDDLVTTIVSICMLIISTVTALAYRKLRTKG

SEQ ID NO: 524 - protein, 664 aa, Methanobrevibacter ruminantium
MYLISFFGLGVKLTNFNDVALFIIFVSLINAILWPILTRILMPFLVLSFGIGTLILNGLLLNFCGPLFGINVEGPAIILAPLAMSFVTTALSTILTIEDEGSYYRSVYRDAEKKRKGEVKDYPGLIIVEIDGLAYDVLKEAVDKGYMPTLKSMIDNTHTLRMWETDLSSQTGASQAGILHGNNEDITAFRWIEKKNNNQMMQCSGVTQVTTLEERISDGNGLLVDNGASRSNLFSGDTDNVIFTFSKILNIRKLYNKAWFSVFSNPSNFARIVCLFIYDMTLEIISQIKHSVKNIRPRIKRGIAYIPTRAATNVFMREINTSTLIGDMMVGDIDVAYSTYLGYDEIAHHSGVRDEDSWYALKGMNKQIERLINTNKYTPRKYEFVIQSDHGQTNGATFKQRYGQSFEDYVKSLLPKEMKMFAKMSSNEDHYAESFLPFSRKNDDLIDEKDLEELGDSEVIVLASGNLAMIYLTQWDYRLSIEEINKFFPELIPGIVENEYVGFIVIRSDEGDLAMGKKGIYNLDTGDIIGGNPLEGFGKNIARHLKRNSSFKYTPDILVNSFYDCENDEVCAFEELVGSHGGVGGSQSKPFILYPSGWNVSDEEIVGAESIYKILKENLKKLKEYSNDNTALEKEYSNDETALEKECSNDETALEKEYSTALEE

SEQ ID NO: 525 - protein, 237 aa, Methanobrevibacter ruminantium
MDISEIIGDAIAYPIHNIKALVIYMIIGIITGILGGASFMGLLMSLTGKNALAAGGFGILGVLVLLIGALLITGYGLDIVKFGIERRDDGPGIDLVRQVLNAVKLLIVSIVYYIVPAIIAWVLFTLLGRGILTVLIVMIISIIFAFAEFMAICRLAKYDSLGEALAIGEAIGDISKVGVIKLLATIIIVVVIAMIVCFILLYVYKLNSLIGGILLGIFAVYLTFFANRAAGLLYSDA

SEQ ID NO: 526 - protein, 270 aa, Methanobrevibacter ruminantium
MNMDFSVKDFNVRLRTIRIWEVVIALVVAFFLTGFTCDYFGIYSGEAEYIIFFLYMMVFFAIASIGTHGFKDDIYGVFKASNLFKVIMIVIPNMLLAFFIQQHLAGFDAMFNNINLLALPVSDLAYEASNPLLFLFEFFSAIFIAPISEELFFRGILFNRLKIRKGVIFGVVVSSIIFGLCHFNYPDHLAHIIYTCLFGMCLCILYLRTDNLLINMFAHFLYNLLSYVIVYTPIGDLFLGGPFMDFTVIVLLFSIVFVPAYIFYFSIKLK

SEQ ID NO: 527 - protein, 267 aa, Methanobrevibacter ruminantium
MDFNVTDFNVRLRTIKLRELLVGIVIAFILSIALLIIFPVMDSYDDLALMVFVFFLFIFFLYALKGTSGLKQDFNKLFERDNSREILYVLIINMLFAFLVLAIFSTFDAYLTLADSEWVSILDFTPTAIDPAVFLFESFTSIIIAPILEELVFRGVLFNRLKIRTGILPAMLISSFLFAIGHEFGGMTSAFVFGMCMCVLYLKTDNILMGMSVHFLNNLIFTVWDLFALDAIVFQMPVLPLTLLISIISGLLIILYLYKEIGKLLAE

SEQ ID NO: 528 - protein, 209 aa, Methanobrevibacter ruminantium
  MOD_RES (4)..(4): Any amino acid
MFLXYGYSYRVTKVSVEGMINGNDPLPEFDDVIGMFVDGIKVCLVYLGYALVPIIIFMVFALVSSAIGGYGESVLMAFGSIITLLAIIGAYVMSMFGVANMANYDGALAKAFDIKEIIEIIQSVGVVRSVGAYIGLAIICTAIFMIVGLLLFFVFGFFGIITGTLGSYTAAGGIFIAGIILGYFLMLFIVSPYILIMQSRVAGLLYNLH

SEQ ID NO: 529 - protein, 282 aa, Methanobrevibacter ruminantium
MASITDIIKEGLKYPFNDTRKVLILGLIFLISGLISLFTQYVVYDSMTLMVNASPYTSVNGMFASIPPSNSALIFLSWIVTFILFLFTSGYIYDVIKYAIDGRYELPDFGNIFAILKNGLRTLIVGIVYSIVPALIFILGLMLMVNEASGEAVNMFGLILLFVSFIVAIFIYLIEVIAISHMVENDSLKSAFQFSEIFDIISNMGWGRFIGALIFAFIVIAIISMFFGMIFGAISTGIGILFDSALVSTLVSSILTGLLLSPYISIALGRMFGSVYKEAISE

SEQ ID NO: 530 - protein, 34 aa, Methanobrevibacter ruminantium
MDMISILKILIALIFEMILEVFEMILDSFRNYYR

SEQ ID NO: 531 - protein, 239 aa, Methanobrevibacter ruminantium
MLLFFIYKFNSISKKNSSSNFNYNSSSNRDSNSVNNSSLSDAFRNDLNSIFKVSKIYHILFIVLANILFVSAIYFVLSYLGSISIIQFNAPLFGDFTGLGFDVTLLYLITVVILSPIIEEFLFRGIFLRRFNLELDNLTLAILISSVLFGICHNFGGILGAILFGICVSILYVKSRNVLVPILAHFINNLISFLLALIGIENFIHGNSIVIALIIILAIISNFVLFRAIVLEWPKSFKE

SEQ ID NO: 532 - protein, 201 aa, Methanobrevibacter ruminantium
MLKFTGKEIRDLIISFIVIALAFSILYSNRDFNGILFIFPIVAIGVGAGFIFHELGHKFAAMHYGYWAEYQLWPTGLVIALVSSFFGFIFAAPGAVVIYSQGMEKSENGLVSLAGPAVNIVLGLIFLGILNSLGQVTDYNGYIIALICLLGTRINFFLATFNLLPIPPLDGSKVLSWNALVWIVAFAISVILLVVYGGYLG

SEQ ID NO: 533 - protein, 53 aa, Methanobrevibacter ruminantium
MAKKDDKYSMPMSGAGLVRYFDDESVGPKIAPEYVIALTVILGIFCFILRYSI

SEQ ID NO: 534 - protein, 353 aa, Methanobrevibacter ruminantium
MDALRALAIICVIAIHAYACSRNFVISELVGNLPSLNWIIIQFSGNTFRIGVDLFLMLSGALSLGRDWKMKDFFAHRFPRIVYPFLFWSILLGTIFLLLSYYDSFNVISSFDLVSIANYFYGVFMGIIDFAKPYWYFWMILGIYLIMPVFNKWILHSDLDDLLYFLFFWLITCLFDYTLGVEFPIRLSYFTSPIGLVVLGYYLRYTRRIILNNQYFALFLIIFSSLLMLVLSAIYSTDTHFYNFNIYSILVSMEVIGVFLLFKNFYKFNLNIGFFSRPDGFFNKSVYALARYSYGIFLIHNAFICVLVHYLGNTGIPPVLYMIILFVVSLLCSVIVMAVLSRIPYLNRVIGVK

SEQ ID NO: 535 - protein, 341 aa, Methanobrevibacter ruminantium
MSENSSFSVDNLVIYLLLIALPIFLFFVSFMLGRYPVAPIDVIKTILSPIFPSLAVSPELNSIVFTIRLPRIIAALLVGAALSIAGASFQGIFKNPLVSPDLLGVSMGAGFGAAIAILANAGNALIQLSAFVFGLIAVFITFSISKTYKAGGILLLVLSGTAVSAFFNALISGAKFMADPYDKLPQITYWLMGSLSAVNFDKLAMIIIPLVLGIIVVMILRWHLNVLSMGDEEAQSLGLNPSRLRLIVIIACTLVTSAAVSISGIIGWIGLVVPHMTRIIVGPDHKILIPASLSIGASFLLLIDNISRTFISIEIPIGILTAIIGVPLFLYLLRKGYSEWN

SEQ ID NO: 536 - protein, 53 aa, Methanobrevibacter ruminantium
MSMLADFEPARLHKRTWAERHDVEILAVICLAISIAMLLLFFALAEPTVAGVI

SEQ ID NO: 537 - protein, 65 aa, Methanobrevibacter ruminantium
MAILLPLMSMLGIGELTQNYILAIVSGMIALVVWYYNEKHNSDLVSGTTKCDCELCYGGDDEALI

SEQ ID NO: 538 - protein, 85 aa, Methanobrevibacter ruminantium
MITTGVVILFNSITEHPYFMEWDEIGIVLGIVSITIACIYIAMIDRWKERRKKEELDTIEDYINRKAEEIANMKVLRKLEELEEE

SEQ ID NO: 539 - protein, 177 aa, Methanobrevibacter ruminantium
MGFWGLTTDCGNLLFPLGYLMADVITEVYGERTARRVILLGLFANILLIVATTLTVYMPYPSYWTGQGAYAYMFGFTPRIVLAGFIAYLVGQFVNARLMVLIKKWTNSKYLFMRTIGSTLGGELCDSCICSSIAYYGIVPNSGILLFILMQYVVKVTWEVVMQPLTYKSIAWARKDG

SEQ ID NO: 540 - protein, 181 aa, Methanobrevibacter ruminantium
MKAIGDNFSVDYLLLALFSSGDLILVAIVLNSYGVISPENVRELVIDYISYRKVDIFWRHLRRPRMSFEDYVLDNFEEMETGELTREQVVEFVSRQERKGLTFCNEIFIAVPLKKGSKDDIVEILWNEYFVEDYKENWLEQHENLGWNDWKKLLKKEIVENGGDDFQIFRNHLIDCVLMEY

SEQ ID NO: 541 - protein, 189 aa, Methanobrevibacter ruminantium
MEKVEQLTIEKIERERERTEQFERAIKEAKEQFERERTEQFERERKERLEREKREKEREKIEKERERKERLERNRIKIEERERERIKRNERIRRENERNRIKSDKREREKSEEKRIKRNERIRKANERNSIKREKRERERERNVMTIDEYYRSIGYGSTGKSKVWSAIIIPILLVICIILILMFYGGGM

SEQ ID NO: 542 - protein, 709 aa, Methanobrevibacter ruminantium
MLKTNFGITKDTLTDLGWSGAADDVKGYQEALDKALEKGGDMDGMLDTTTGHLETLKKNFRVAGRHVGEMFTPYIDMAVQKLNGLKETCPGLFENLVMIAGAVSGFATVAPSIAPMISVFGDVGSAIKRTAGFLGLMEVAEDAVTLKSTFLTIAQIAGADAAVLQTAANSGLTASFWAMAAAILANPLTWVAVALIAIAVAVYEVGKSFGWWSDIGSMIGAVWAGIQRLWSAFINNPNVQGFLKDLSNAWNDICEALAPVIDWARKAWAELFPPSATGSFDIVRAIIDVFGQLGDFLGKVVNAVKSAWNALGGFAGFLPMLLGPVGMVVMALRMIVCILLGCSPGIVPALQKTQSVFMSVFGAIAEFIGGAVSNVVAILTRIISALTGIFTRVSSIVSTYLAKMISSVISWASSIVSKAKSASSKFLTNVVNYFSKLPSKVWNHLKNIIQKVTSWATSIVSKGKNAASKFLTAVVNHFSKLPGKVGTYVSNTASRISSGANKWVSNARSKASSTVSAVTGPISKLPGKVYNEFMGIGSRMLSAGSALVSKARQIGSNIVSGLLNAMNIHSPGTIQQKVVAEFENTLSRVGSMDSTALDVGQSVGNSIVRGFTDFGLDTGSFNADYSTDYNLNRKNDDNLDVNIKQELEFVFDFKNLPNDVDEDKLLEMLKEMVTDKSVIQALVSNPDFQSMDTKVKNSIIAKVKRARGV

SEQ ID NO: 543 - protein, 226 aa, Methanobrevibacter ruminantium
MDLIFEYLIVFILLFATNIAFLLRYSSFNKNKFIPFVLGYAIIVFALTFVFSSLNLQKESIDFIPYILFAVSALMLIISIRYVGFGKNYGINDDKVVLYGTILSSFLSIGALALGLKSDNLFLSGLELAILSVVVIFLVYKISKIFNNAKRPYYAVIGEYMFLEFILLLILALTFSSVRELDYSMFGSFLILTPTYKVLYMIIAIVILLVLGVLYNDWVLKRLKRK

SEQ ID NO: 544 - protein, 213 aa, Methanobrevibacter ruminantium
MILQGTEILTSFIHIVSESLLAPVVIVLVIFLIYAILSFGGFLNEWFTKKPLKSAGLEKLLQDISSSDSPEDLKAVIDASALYKEQKEILVKITDNYNLGPEARKAFASKLIEEEESNLLKLTTKTDILVRLGPIFGLLGTLIPLGPGLSALGTGDITTLAQSLTIAFDTTVTGLTIGALGYIVSKYRKQWYESDLTTTETIAEAILEKLNQF

SEQ ID NO: 545 - protein, 105 aa, Methanobrevibacter ruminantium
MLRKRKRFSDDGDEDPMSGISNLSDAMLVLALGFLIFAIMALQVNPDMMAKTQESQAQQATSQVSTGQDFNSSANAGASLEQSGYSEVGKVYKDPDTGKLVMVQG

SEQ ID NO: 546 - protein, 273 aa, Methanobrevibacter ruminantium
MSFKSPADTAKAVASAATAKGEMPIIKLAILGFLAGAYIAFGGLLAEVANTGAIAGGVPVGISKLLFGAVFPVGLIMVVICGSELFTGDVMFMTMGLLDGKTDIMGLLKNWVGSWVFNLIGGLFVAYVLAYLTGIMVPEAFAGGAITIANTKALGGATFMAAGKSTASLTWVQCFLRGIGCNWLVCLAVYLANAADDVVGKFFGIWFPIMAFVCIGFEHSVANMFFIPLGIFLGAEVTWAQFFINNLIPVTLGNIVGAAVFVACAYWFVYLRD

SEQ ID NO: 547 - protein, 539 aa, Methanobrevibacter ruminantium
MALNIASVVDASFVSTFIGHNAQAALQVLEPLVLLITIFEWLFGLGGQILALNKKAEFDEGGSNHYFTTAMLATIVLSVLILLVCFLFKDSLINLLHPTAGALPYVNAYSPYLFISFPIATILGVLCQFIRVDGQPNFASGVIIVANIINIILDYLFLGVFHMGIEGASLAMMIGYAVGLLCTLKYHFDSKRTFRFVFSELKFGTWIRSTIEIIKIGLPGASMGFFNVLLIYIMNLIVGGVLGELGLDIFNVCVVALLLISILIMGFAETLSSIVPIYYAQNDFYNLHHIVRNSIIITLVCSVIFTAFLLIYPDGLLMFFKLHQTANDGLVENAIRIYSLAFIPMAFSTMLLFYYEGIERTVESGIITVISEFLGPLFFTYLLYPFIGITSVWLSFPLGFILSIVAVSIYVKVVERKDSEYSGLFFIRRGLIEKTRNYTLESKNDAVKSEMFNHLKSLNVDDSSIETLDKIIGTIFDSNNEKVHVEILLIDYGDKIVINMKDEGNREVMKDIEKSFSQDKIKVSEVLGFNNVEYLIDGA

SEQ ID NO: 548 - protein, 300 aa, Methanobrevibacter ruminantium
MNIIKNLPLAITGLILAILSLGKIFADFSAIFFIIGSILIFMVLLKLVFHFNDFFNELNNLIPLSTFGTFSMALMLWSTYLKPLFLPLSQDIAFVIWILGIIIHLSIILFFTNNYVLNNFNIEDVYATWWIVYIGITMAAITAPAHGLSKYGFIFFGIGFILMIPTLVLVSYRYINFKQIDDQNKPFICIYAAILSILIVGYVNAMTINGTFLSIIYIGAVIFYIFAIIQAFKFIIIERLKFMPSFSAFTFPFVISAIATGEAYKFFGLDILNYLFYIQAFIALILVIFVLYNYLKFLMN

SEQ ID NO: 549 - protein, 410 aa, Methanobrevibacter ruminantium
MNEQTKLSKDHYMIFGLSWAGWVFDFYDLVLFTFLISQLQSSLHINAEMLALCLGLSLFATGLGGIIFGALGDKYGRKKVLEWTILVYSIGTLLCAFSWSFYSLVLFRFITGLGVGGEWATGQIYISETFPDNLRAKFGAFMQSGAPVGVILASIVGGMISPIIGWRMTFLVSIIPAITIILIRRYLKESDVWIKNKDDFVNKNIFQEFKQLVSKEYRKIFLISLVLCIFGMSAYWFTYSWLPTYLAEERGLAMVTTSLGIILIQCGDFTGYTTFGFVAERIGRRPAFTIYSFIMGISIAMITICWNQIDKVPDLIMVFMFLTGFGTGFFGGFGSLFSELFPTKIRNTGVGTVFNLARGVQFITPMIITFVGAYYDLSYGIAIAAIFAFLVGIWIWVFPETKGTAINDLD

SEQ ID NO: 550 - protein, 400 aa, Methanobrevibacter ruminantium
MANNSVLRRIVSLITKHNILSIGTKYFPTTELETEYVDMFNYTQTMLMEIDKANITTESIFTNLVRDVGRENIPENHSFYELLPAQNKIDEYALVSKIIMGSDRYMYVELSEPSYIIDYFTDIILRENGEIIERSETEIVSRLMSKNDAIRIAIKLVGIGLDNNIRVRAAAGMTGAAAIERSIKFNKEVGDVPGVAFTKLGGEYALVLDTPFKLGQSEHAEYQHYLFIDIVDSTNFISKHGKNKLVELMTSVKEFMENCEGHIEGYREGGDDLIARFPSKGVAIRAGLDCAWFILNNGAKVKIGIGRSRREAGERANIAEGIKGFGALTLIVFDLANGLYAYYVPSDFSRTLCELFTTKKGKLVTAFLLVFILCYLLAVLGFGLYGILVFIIVVAYYTLK

SEQ ID NO: 551 - protein, 244 aa, Methanobrevibacter ruminantium
MRKVFESIIEALKYPFRDWKNIIVIGFLLLIASLGRKLPFPEDPQQTVVFIGALLILFLQTGYGSKIVYSGLKGENIPPKLRPIPKLIWEGFKKIIIIIIYVHIMVIFISVGKTQLSANNIPIAIILFVLGGGTYLLMVGGLLNRYFHHGKFIKAFYLKEIIAIIKKIGFWDMISIVICAMISQTLTISTFINLVKGMFTSIELVLCIIAFFLAPIALMSTKRLISLNLRRILSSDEDLEKFAF

SEQ ID NO: 552 - protein, 369 aa, Methanobrevibacter ruminantium
MDYLLITLKCDKMDLNYIIVLFVLTFLATVAFTYFVRHTLRDADVSDSPIVSEHRHKAGTPTMGGIAFLFAILFIVSIYYRNTNILIASFIMLTGGVMGLLDDLLGLKIKEYQKVVKNVSDSVVPIGLLDLGPGEEARVTTDKAKKQVYGYVDEGKLEIVAEIPIKYEPSEKTKIIVQLLPGLFLALTGVVTTLGGFTLGILAYPICIIAILGSINSINLIDGMDGLAAGIVAIASFSCCIYAYICGNMDMIPAFAILTGICLGFLVFNRYPASIFMGDTGSFVLGTGYAVAVILGDIPYFGVLALAVPIVSVIISLMHRAHIINLPVEPLHHTLNYKGISEVKIVLSYWLLTVLVCAIGILAKLYIFA

SEQ ID NO: 553 - protein, 179 aa, Methanobrevibacter ruminantium
MFNPIIALSYISSGFFMKISDDEYDEKNNKILAIIFGIVCGAFTALASSMSTDAACIFIAILIGNILAQKVDGIHHVVTMLSFLIVLVFLGLPAFSRPSILVVMICVAGALIDEKGNDNEILYEKSKFLMYFFDYRFALKVVILALALFGLVDIWTFVYFLCFEIAYEIARVLFEKFIL

SEQ ID NO: 554 - protein, 70 aa, Methanobrevibacter ruminantium; identical to SEQ ID NO: 309

SEQ ID NO: 555 - protein, 256 aa, Methanobrevibacter ruminantium; identical to SEQ ID NO: 320

SEQ ID NO: 556 - protein, 110 aa, Methanobrevibacter ruminantium
MVRKKARRRKRQEEDPMAGTTNLVDAMLVLALGFLIFAVIGWNLQSVIFSDMDPQERQATMESINQITNVTQGEQLNSTPDTSNQSGEGYVEQGKVYKDSKTGNLIMVET

SEQ ID NO: 557 - protein, 243 aa, Methanobrevibacter ruminantium
MELIFSVFAVISLAAILLLGIELGLLSKFFNLSLKKHLILVLAYSIIIFAVIVILSPSYEAVLNSTFYSFYYYIIMGFVCLALGLLTLFYWSKMEWYPPALKCLLYFDFVPISLSLMLISTALMAPSFAFKVQNFSLNLTMVNSGLILVVLMAILMVIFYLFSDFVEDYRVTHYAIIIGSLLLIFALAYFVLGFIIPNMAPVFANPSTELTLMPIESIVVMVVLIALLLGLGALFRKRTNRLE

SEQ ID NO: 558 - protein, 218 aa, Methanobrevibacter ruminantium
MIILAMTIPGGDFLTTGLNLISQSLLIPVVIILLVFVVVVVISLGGLIYEYTSRTKVSVDDVSNLILEISDSGSVDSMKSAIANSPIPKLQKDILLKIASTGNMSPNTREAFARKLIENEEGLTDKSLEITDIITRIGPTLGLMGTLIPLGTGLAALGSGDVNTLSESLIVAFDTTVVGIGSGALAYVISKLRNRWYEEYLSNLDVLSDAVLDFMAKH

SEQ ID NO: 559 - protein, 283 aa, Methanobrevibacter ruminantium
MGLSLYLLLDLILITFTLVFKIENNLYYIIIAIDTILCVILIYEFYNRFKTAENKIHFSIRNSTEILAGIPIDLIFLPFAPNLTVFLTIFNLLKFLKIIGLFLEFFETIDVFLKKTHLDEILGLAILVILVSTLGIYLFDPSINSIFDSLWFVLSTITTVGYGDVLPNSYIGKVIGILILIFGVLIFSAITGAMTSYFARKVFATKDFNITENDDNIRLLKEDLSFNKKNLNNANEKIDKINNDVEKLKRELNEMKEELRESRQLNKELKEEIVILNENLKNK

SEQ ID NO: 560 - protein, 237 aa, Methanobrevibacter ruminantium
MLLHEQAFQLIGESIVVLVVLIIIILIIALILGIILLRRNKLVFPSLIIFVVNVFYSPLKSLANFLRLDDALVDHIGIEVRNKVNKPKFDQIPPEEKIIVLPHCLRSRDCEASLKESGIKCTFCGKCAIGTIKSKAEPMGYKVFIVPGSSFVKKIIEQNKFKSVVGVACHVDLNQTMMALSDFYPQGVLLSTSGCFETRVDVSKVLSTIGYYEYKEKNKSIDDEKDDSEDIGRIKPS

SEQ ID NO: 561 - protein, 283 aa, Methanobrevibacter ruminantium
MNFNLKDMILIFIRGFLMGSADTIPGVSGGTIALITGIYERLIHAISSIKFGFIKPLIKLDFAGFKEKLFEEIDFELFIPLVLGIGIAVLTLSKVIRYLLQNYTAYTFSFFLGLILASAYILYTKLDEINIKLIILTIIGIILSYIFVGLNPIAANHSLIVLFFSGMIAICAMILPGISGSFLLLLLGQYAYMLDSLNSLNFTEIIVFIAGAFIGILGFSKILNYLLENYESATMAFLIGIMIGTLRLPFNQITSNLTGSWLICLILAIIGVVLIVVLEKKLS

SEQ ID NO: 562 - protein, 322 aa, Methanobrevibacter ruminantium
MKGTWKLKLRLWLSMAVMFGLVYVLIMLAGNFLGYRGFYGFYAIAGLFVLFLQYIFGPKIVESSMGVHYLSESEAPELHQMVAELAQAANIPKPKVGISNTMVPNAFAYGRSKRSGHVCVTKGILGLLDHDELKAVLGHEISHIKHNDMAITTVVSAIPLICYYLGFSLIFSGGGGDNNNGGGALIGFLALIAYFLGQLIVLFISRVREYYADAGSVELGCQPEKLASALYKLVYGAARIPEQEIKDVEGTKAFFLTDISNARNEINDLSQLDFNRDGVISKEELDQLKNNNVKISGSNKIMEMLSTHPDMLKRIKRLADMN

SEQ ID NO: 563 - protein, 210 aa, Methanobrevibacter ruminantium
MKKMICPKCNTVNDDNEKFCKNCGLQLNTTRICPNCNTANKPNSKFCHKCGTTLSPVDTFKKGIIEENTSNSFFSTYKIPIICALVILLAIGAVTGVAIFGGDGNNGINSIIPLANDTYDDTNLNNYGVNHDNVSQTQSDNFTENQTDNLTDNQTVNQTVENKTKTATVQNQTDNNKTSNNDTNKTKVYSEKTNTTNSSAKVNTEKTKCN

SEQ ID NO: 564 - protein, 352 aa, Methanobrevibacter ruminantium
  MOD_RES (278)..(278): Any amino acid
MKHRLNLDKKDPNYILLKEIFKIMDSRESKQILVSYGFKNLNRTIFAFKIIFISMFFEIDIPFILNELKSNRRLCKFLNISEVLTADQVYKIFSEINSEKLIKSLNRILNSRNMVKRRGKKTFIVDATPVDLDINFRRNKKSKEHLKKLNLKWSYSSSKGYYIGFKATVVMDYDSMNPVCILIHSGAPNDAGLFEEILENLQKRRIIRKGDTLIFDKGYYGYKNYQIGISKYKIIPFIFPKEKFSRTRLDDILTYPLAVFNKTKRIMEEKRLYNNLKXELIEKIDSWEKFKPIRGKIEDFFKLLKQGLNMREIHKYTLKSVEKTVYLNVFLGALIISQGFYSKTTIQQLSEN

SEQ ID NO: 565 - protein, 212 aa, Methanobrevibacter ruminantium
MIGDDDFFMQNADYHYGASDSEKMYGRGYDGSSDYVPRYSSGGSYGSSSGAESSEDGSLGKYCLIGILIVLGIVVFANIGIPAITNSLSSSVTVDDLNITRYIYSNQYNSKITTDYGYQITYKERSYGQHATNVIFYSKNGKVLYNDSQYMGTCYLGEVPYIIYFDGKADYAIFEVYKTQFDSGECIYRERVDVDNKNVIKEFINYDTLYDD

SEQ ID NO: 566 - protein, 76 aa, Methanobrevibacter ruminantium
MAELMDKIFVVIGYILAILFPIVGIIVGALLYFLKKEDAFYQTHGKYIIIVGIAMIAINILLIAFGIITIPPVGQV

SEQ ID NO: 567 - protein, 261 aa, Methanobrevibacter ruminantium
MDNRNILIIIGIIVLIAAAGIILVMLTSENYERMEIVPNGTSIDVPLNKTTYDGEFQSARVWHWDKGILVTYNSHEDKNILRVSELGIYTLNKIIETGEKENIDGFTSYVINADEILEIELFDAIKLHYTGKFYCIPLANGTTGDVIIICSNDRDEAVHMAKSIQYKNVFPVNSDFNNTIETVENLSEYLESTVNDYANSTDFDNAVSTVENLTGNLESSAKDYVNDANLSDVKTTVEEKTGINIDDAKSDLEQYIGKLTS

SEQ ID NO: 568 - protein, 251 aa, Methanobrevibacter ruminantium
MPLDIIEDIWKYTTNNKTFLLIILVLFYLFCMFMQIFDEMRISYALYLSMIPYIFIAGYGMAITKDVIDNGKRLPKILIKDVIVLGIKSTVVFIVYLSVQGIFFSLVSYLCNFPIIDVEDLLLDFFETAPLLFHHNLVNTLIFIVVDFAVFYFTMFFMEMGLAKLADTGRFLDAFNLIKIKKIIDIIGWRLYAKHYTVIIFLLWVFSLLIDVETPFFVLDYIFKVFLGLLLFITQYWGIGAVYRIYKIKTN

SEQ ID NO: 569 - protein, 165 aa, Methanobrevibacter ruminantium
MDIRKVIGIILIILGLIFAIYPVYSAQAVSWIAGVALIAFGIGLILDGFSIWSMMAGVSAAKILLGIIAAIIGFMFLYKVDALSFIIAYQFYIIGFILIFVGLLGIFIAIDGISRATAILTLILGIICIICAFFSLSQPLYTAVIVGICMIMEGITFLASGIIDE

SEQ ID NO: 570 - protein, 530 aa, Methanobrevibacter ruminantium
MDKETKERLGEIRAAMKKYGFDKILGESAKNRIRGKDEEEESLLLDSEVPVKFRLMLQELGTTFIKLGQLLSTRPDMVGEDIANELANLQDDNPAISYEQVKAIVERELEGDIDELFAEFSHEHLATASIGQVHEATLNTGEHVAVKIQKEGITDKIDLDIRIMKYIANRADRLSGELKKVNLPGVMEEFDRSIHKEIDYYNEFMNMQRIEMNFVDNPNVHIPATYPKYCTTKVLTMEFIAGAKLNDVYASEGDEFDKKLLAKTVIDSYLQQLLIDGFFHGDPHPGNIMILEDNVLCYLDLGMMGTFDEDFKRNLAEAILLIMDQDIDGVINQLMYMDILDYDIDTKPLKRDLNDLFGRYFGVDLNRFDGILGDLLKLMQEYGVVLPNELVTMARGVSMVEAIAHNLDPEIDIFESLKPIAKRIARERLDPKRYLKSKKSNIILYEHMFRALPQLLTRTVHKIENEELQFRFEVDITDKVSIVALVSALIVGSSVVSFGPRAFDMPVISIIGYIIAIILSIVGIRKFVLK

SEQ ID NO: 571 - protein, 230 aa, Methanobrevibacter ruminantium
MTEIDWFKFEDRDYDFPFYKKNPHISKMGWLVLFFVFIIGSILSMSDKLSYSILCCIVFIVPVLYFLDWDYKAIFRKPSLKDIALAVALFIGYLIYAIIMGAILESVGIVSSGIIDPGSIDWTVLIKSVFSLMGEEFIKFLPFIFFLRVLYKYTDNRKLSVVISVALVMAMFASLHAYNWVMFIYALFIQGFGSIFEFFAYIKTKNIIVSYITHYCTDAFIFAMLLLGLG

SEQ ID NO: 572 - protein, 240 aa, Methanobrevibacter ruminantium
MICPSCGSENKEGSKFCKNCGERLTDSSRPTSTNASASSQSKSNKNLLIICATIIICVAVVAGAILFMSGQSTDYEVASGEATNDHSSSALNSYDSSNSNDESQDDSASASEDSSDSADEYNKNHKWGKSFQEASEYFPEASETVVTHVFYEADIDGNGFLTDNEFKDFKSLVSFTRKYAADVTNNDYVDTPDLWEGDGSVRTRYCADHGRIAVGSDDRCPYCAKKGQDSRTRSGSTRYV

SEQ ID NO: 573 - protein, 52 aa, Methanobrevibacter ruminantium
MSKKEDNCQIDDCSSGTCAPVSPFSKEGILFLIFIIVLFIVLFFLLWTNGLI

SEQ ID NO: 574 - protein, 452 aa, Methanobrevibacter ruminantium
MTKLIKREVKREYNEESPLKLKIANAISTFTNPPIICIPLFLLISFVLASNGNPFSSSFSFDWMLFAKCEIISLVFASVLPMAIIIYWAKKLNTDKDISNREDRFIPLIVGVLSYLIGFVISFFFELPNFLTILLLCYAVNTFIVMLITSLWKISIHTTGLSGPVAALIMLLGPIGALFGLLYPVLIWSRVTLKKHTMAQAIAGGIFGFVFTVGESYLYMRLFKMSVPGLVPLAECFWIIFALVACPIVLGICGLLEKRGIESVIRAKLFHLLAFIGFAAFYFYGPSSAVLILILSAIVSVLVTIFAGDTFSWYKGISRGLERENLSIVLSLACGLIWIYVAMNYFNIESAIIATIIVAFVGAIAEPVAIKYARYKFPMKSLLGNDGNKSIESSVVALIVTMIILLLFTQNVFVSIAVGLLVCLIETFVPKELENLVIPVACAIILGFLLHY

SEQ ID NO: 575 - protein, 46 aa, Methanobrevibacter ruminantium
MKERVCSPDCEKVLEMNQKNIRKSRIMLFAVIVVFILVWAYFMFFK

SEQ ID NO: 576 - protein, 304 aa, Methanobrevibacter ruminantium
MPSEKVKEFNESLKTKEGRDKFFKQIFCIAIGTVVGVATYAFCLYFNLAIFGWNIGLALSPLTAGYAESILAKKILNESTGAISAFILFIITVVYGFFISNSTLGFNIITAGSAVVIIQAAMPTATNYLLLAVGVGILTYVTGFLKKLHSALYKGYKKIFKREPKRAERYYQKQASQVHAFYDENLDINSLGVLIMTLEYPPKELNIIEQKGIYETRHIFGSKQKEDIKSGLEDSLEEEVINRVKLARDKTLVKLIKEVKADGCNGLMHLHTTYETLGTEKGDHIAQVVMRGTGIVIEKEEEEY

SEQ ID NO: 577 - protein, 245 aa, Methanobrevibacter ruminantium
MVPLQFFLFTSVGVDPSLAMMVSLGTSLAIIIPTASSGAYQHQKKNKSIVRPGIRLAVFGIIGGFCGGLLANMVPTRILQMIFACLLIFVALDMLFGSRSDGEKALIDFNLLNGGIVGFSIGIISGLLGVGGGVFLIPSLCILFGFSLIEAIGTSSVFIAFTAIGGLISYIYTGFGVNPMPYCLGYVSLINFVVIVLFSVPMATIGAKLVYKLPEKRLKQIFAIILIYMAIKMLGFDPISILLGL

SEQ ID NO: 578 - protein, 352 aa, Methanobrevibacter ruminantium
MNLKINKYIPFGIILIILGGSLYFLSGIDQFIRPFTQPILMGSSKGKDILFFVLFGITIILSSIGDNERIHNYLMNLSIPEKLKDKDFYLKLSLILFLITAISGLAVELYLRASLGLNWNTILVIMNPSLTSTSFLHSHLYKSIFGIILGIFLSHIPAGIHTGSSLSSYAPSVISLLFILIPITYISMVLSNQRRKAASRILLAFTSTLGIIGLIDGGLFATPAIGGIYGILILMYNEEILDGISDFITEKDKRDGIKEKLNEELRAIKSIFNNKNIKKYLKIALPHIALILIIILRFSVAFYGACPDSYELIISNGHDLDLDEYDTLNISENGDRTVVHLSNQYNEMELFK

SEQ ID NO: 579 - protein, 113 aa, Methanobrevibacter ruminantium
MVKISRKNSFDESSEEDPMSGVANLVDAMLVIAVGLLVFLVISWNMQSIIFNEDLSPQQKQEAIDAMNQVIEVDQGQQLNETPDISNSSGEGYTEMGKVYQDPKTGKLIMIEN

SEQ ID NO: 580 - protein, 209 aa, Methanobrevibacter ruminantium
MGGGILTYILDTLSQSLQIPVIIFLLIFAVGAIILLGGLIREYSHRKTISDAEMRNIIDAINKANDKSEILSIVDSSDIPNSQKTVLREITDSDWDNESRVGLAKKLISSREKRLEKRLSYTDIITRIGPTLGLMGTLIPMGPGLAALGTGDVVTLSNAIIVAFDTTVVGIGSGALAYVISKIRRRWYSEYINNIDVLTDVVLNKLNKL

SEQ ID NO: 581 - protein, 935 aa, Methanobrevibacter ruminantium
MGENDRSCLNSCSSLKYSLGDNKNNDLDNSADLNSLNPNSNNCLNSNKNNCNCYCKNQTDLNDDLNDSDNCPDSFAKKTNINHDKQLNDGEIDFSERNNQIFLISPENFSVFFDENNRLKEDYGGCTLVFEGDFAELGIIDISYPYTRITAKENSFKNTAFKLSASDIELSNLNISLDKEFKDNEYAGILVLSDYISIYNITLNYTVPANTNGFCIYSKGEGFRRITDLSLINNTITFTGNNLNEAWDYGIFLDKTDNALVYGNSLGSYLPLCEDNWYNNEYGAVSKMSSAGFVAQSCNDLKLSSNEINTYVTDSTQSSFAMDSCILYDCSDLTVERNTLYLEDIDSQDGKNNTLHGFDLYLCDDAIIAFNNIDLFTMGGNDGRKITSPLQVNGPSDNIRIAYNNITSSNFGSNCGIYSHNFYGDTHLEIISNFIDVAGFANSGEWSLLSGIEVQDSDDVIWNNTIIVTNLGDFKYNNKVYGISYSQNRNNYNSTFNVQYNNITTNGYYAVYLGKDDYPVVNSTVKNNVLNTYITGGNPAVSIANDNKNNPIVNNTDNEFKNIFKNSSFPKWLKNFLRQDTKVDKDFSWITDAINPQSNGTGFSNDTGNGTGIIDNDGSDTVGNNSEGSDSIVNGSTSANGTGNGTSGNATEPQNPIDDNQGDNSGGSSSSDNSTGSQTDNEDSNQNNTDPTDSKPTNNTDVPVNPTNTSDKPVNSTEPVPANDTEPVPANDTEPVPANDTGPVPDNKTDNPVNNTEPVQEDANKTDSDNTEPINTTKDNSTEIINKTESDDDTNQTVLKDDDLDPKESHENSQDDNKNPSDDEEKSTPGDSGNELTDPESNSESPQNQEENSENSNDDSSEPSSSTVGDSHSDSASSPGLSDASSSKNAYELDKPVEDLVTKSVDYISLAGICIVTLLLILFGYKRQKDIEGED

SEQ ID NO: 582 - protein, 384 aa, Methanobrevibacter ruminantium
MADEIATIISSLGLSNEAFLAIVLLAFVVIGAIIVIVATRPILDVYPYLHPNARVRARKGRLFDEKQISELVEANNVDEITNYLRGSPDYADYLDNYTLEKALDIQLGETYDMVSRMAPKEIQSSFKVMAKKSDINNIKSLLTAKQAGLNEEATADLLIPTGSLYEDIERLTDADGVTGVVAGLDGTEYAPVLEEALPEYEKTGMVLPLESALDKYYLSKLLASSETPSDENKQILYSYVGNQVDVANIKLILRAKADGLDYEAISPYMIDSGYQLREWKLKDLMEAEDVTGVISGLEGTKYSDVLVEVLPEYNETGSVALFEKALDKFLVDSAKSYSMKKPLGIGPIIGFLSQKEVEVKNLKVIARAKREADFPISKIREMLV

SEQ ID NO: 583 - protein, 161 aa, Methanobrevibacter ruminantium
MVEIALGTALAAIGAGVAIGFAGLGSGLGQGMAAAGSVGAVAEDNDMFARGIIFSALPETQAIYGFLIAILLLVFSGLLGGGEGLSTTAGIVAIGVGASIGFAGLGSGMGQGMAAASSVGAIVEDNDMFARGIIFSALPETQAIYGFLIAILLMVFGGILG

SEQ ID NO: 584 - protein, 662 aa, Methanobrevibacter ruminantium
MRKLNVITLDKYAGPTVSALHDEGIVQINDISERIQQDPKLAELLKPSKVTPYTGKLSSLLMKTSALSDLLGDALSEGQSLKDTLMSFISPDLPVPKEVEDVDTESFIAYAESTLSQVEAETKGIEDKLAALDSEESKLESNKSLASKLKNLDMDLALLSDSKYTSTIVGRITAESAQKFKSEYSKITEDLFYELVPDDEKEYNILVVVVANEFKDDIYTLLRKNEFEKFETEDLQGRPDSLISSCESRLQAIESERSQAKADLKVVAEKWDDEVLALKEQLENEKEKNEVFATFAETDKTVVLEAWVPEKNLEQAQSIIETATDGHVIMETEEVPDNAEDVPVLQENCTYAKPYELLVEMYSPLKYNEIDPTLFVAITYPFFFGFCLTDAGYGILVALIGFILYRGMGKVNRTMHDGGLIIIASGIWSIILGLFTNGFLGDMWTRILGLGPALPTVIDSINAFKFPATILVIAIVIGIIYTNIGFILGAIDNLRYGEKKEAIGSQIVWFVFELGIILLILGFLFPTFGMIGMALGAVLIIAALGMLIWANGAYGLMDVFGFMGDVLSYARLLALCLATGGIAMTVNILTNMVNDMIPFVGIVLAIIIFIGGHIANFLFQVLGAGVNALRLNYVEFFSQFYMGGKNSYQAFKAKRQFTKVKK

SEQ ID NO: 585 - protein, 112 aa, Methanobrevibacter ruminantium
MRKIILLAFSALLIILGLWNYMSVPKPGLDIIASSLVLVAVGWTLAMSVFEPNWIKAAIFIDGLVFVLVSITFLVSPINYVFLLFGIILVAIAVLAYLRKLPDNILRYFYRS

SEQ ID NO: 586 - protein, 123 aa, Methanobrevibacter ruminantium
MKPKIVRARDKEVMNQLAKLFEESKYTVKSQDKNYVLLKKNNYGNPLIHLPFILIGLFFNAFAILVNVAYFAYSVFKKSNVILITTEKNDEDGNPLEFDDVGEIEVFYDQETWDKAIELSRLE

SEQ ID NO: 587 - protein, 416 aa, Methanobrevibacter ruminantium
MAIGVKEIKITDTISILLLPLIYALVLGLALYLAKPIKFIGRKQSKVAEGAMVLFIGVLITKLAISSGQAIASIFQVGPALLLQQIGNLGTLIALPIALFFGFRREVIGMTSSICREPNLGVIIDKYGFKSPETRGVLAVFVIGSILGTPFISFLSSISASLIPMHPYAYAMASGVGSASMNAAALAPLMHMFPSMATDLEAFAGCSNLLSFCFGIYMCIFVSLPLAERMYKWLSPHIGHDKEETIDDEYAIEGVKHDKYASKEELSSGKIKRWATFLLIFSFTVAVGNYIGYHTSLLDSFIGMIIISLITILGMSLERIIPWNIQSIIYISLIGIIVAIPGMPTADFIVRYVSQIDLTTICTAFLAYVGIAIGNDWEEFKKIGWRGIIITLIVISGTYLCSAGIAHLTLVATGMV

SEQ ID NO: 588 - protein, 36 aa, Methanobrevibacter ruminantium
MEITTKRKTTMWRLYSFHGGLFLIALSVFSLNGCED

SEQ ID NO: 589 - protein, 72 aa, Methanobrevibacter ruminantium
MKNHAISRKEFKERRIDMELNSKHYTIILIIAIIIAVIMTYMTGIKNPIIIGLCILAIIVILANLYLTKLKK

SEQ ID NO: 590 - protein, 309 aa, Methanobrevibacter ruminantium
MFVEDLINNLSNFIESRLSDKILIFLQEYFLKAGIFTLASQIIAILFISIVFTLILALMIALLFSFDILMAILLAIFIPLLSFILFVFIKSERRREELENSIPDFLRQLASMLRVGMSLENALVDLSEHGNGPLYDELRRVVVEIRMGKSFDESFRNMAKRLDSKDLERSFKIILNAHKSGGGLADVISDVSDDLRAMLILKRERKSSVMMSIMFLVLASVVAAPFALGMVGVYSSFMIELNRSSAICQLAPTVALIYLIIHSILAGFLIALIMYGDIKKGVKFSIPITALAFFLFYLINVFGLSFFGF

SEQ ID NO: 591 - protein, 145 aa, Methanobrevibacter ruminantium
MKMEIIKRIGIGAFVGCFVVMLVMVLGTYSLGPQNVSFSGTEIINAFFGSIVVGWAFAFSGLIYEKEDIPLPIQVIFQMVIGLGTLFAVAVYLGWMPISLGIGPIITWIVIAIAFAAVFWLGFYLYYTFLARDINKKIELSNDFD

SEQ ID NO: 592 - protein, 148 aa, Methanobrevibacter ruminantium; identical to SEQ ID NO: 205

SEQ ID NO: 593 - protein, 612 aa, Methanobrevibacter ruminantium
MKGNILKNIDEIIKSDFKSAFSNPIVVIVLIGIIILPSLYAVLNIYACWDPYGNTDEVVFAIANLDNGSTFKGDYINIGNELVTEFKNNNDFKWTFVSEENLRTGVFNGTYYAGIVIPKNLSENVVSIATDNPKQAKLEYVVNVKTNPVASKLTDSAANRIYMALNAKIVKIIDLAAYEKLGELQKGLASGSQQLSSGGYQLQSGSAQISSGSHQVSSGAKQVKDGKQQVSTGAETVKSKASDLDEGAQTVQEGSNYINQKSEELQQGSDEVQAAADPSLMPDGPVKDYVDASVELANGSGELAKGSSQLANGSVQLANGSVQLANGSVQLADGSVQLADGSVQLADGSVSLAAGAQLLSSYAVQALFTASSSLGATANELGSVTGINKTLLGNYLYAPIALEREEMFSVPDYGSDIAPFYIVLSMWVGAILTCVMLKTGLSTGTKYSALEMYGGKLVIFVILSILQACVTIIGCNILGIHIVNLPLFIFSCILVSVVFMILVYSIISALGQVGKAIAVVLLVLQISATGGIYPIQIMHGFFQTLYSYMPMTYGITLVREAQLGTVWSNYWPALAILFAIGIITVIVALLIKVKADKASHYFEKRLEESGLF

SEQ ID NO: 594 - protein, 118 aa, Methanobrevibacter ruminantium
MLDIPKEDPQVRRFIKLVKEEGYSYEKALEEVGADYIDERDWEYFGFNQREGDYRDFYNLRHPPKEHHYLSGSNSSSGSSSNKRQSSKWDDLKCYMSVLGPLIIIFAIAILWGVFKGG

SEQ ID NO: 595 - protein, 302 aa, Methanobrevibacter ruminantium
MTLPGASIGLAELFDPDWSLLYNYSIWMAAFGQIFFSLSLGMGAGFTFASYTKRDIDLISSGLCVVLANSLFENFAALGVFSILGYMSLESGVAVSKLVSQGTTLIFVAYPKVFNILGGVALILGPLFFFTVYVAGVTSILSSFEVLSISIQDKFAFSRKKATTALCIVGGLASMVFATSAGGYLLSIADIFVNNIMVLFSVIVQTILFAWVFKAERLVDFFNAKSRFLKLGRWWLILVKYICPILLTVIWIGELYNLIKMGSTEFVVILGVLLAILLIFAFIFTIRPAKTDEWFKTEERIK

SEQ ID NO: 596 - protein, 188 aa, Methanobrevibacter ruminantium
MANENEWGSNLAFVLAMIGSAVGLGNIWRYPYVLYSNGGGAFYIPYLIAILVLAIPLIILEYGVVYNYKSSFTKAIVKIKPKLEFYGWILPVVTFIMTIYYSTILGWDGIYFILSFFKGWGSDPNTFLTVSLLQSADSISGILNFIPVIAISMIFIWLIIWFISHRNLDEGLGRVARYFVPNAFFGYK

SEQ ID NO: 597 - protein, 257 aa, Methanobrevibacter ruminantium
MPNQMLKGSVRYCTENKTLFLIVFIQFLIFECITNKVGGIMKTTSVIVLLVILGYGLKVTQDVINGGTSLPKISLKELLNFGVKGTIVYTFYLTIQASLLGLISLAMNFPEFELEEMILNLHETIELFFEHDPISFILFIILGLLIVYGTIFFMEIALAILADGETLKAAFDFKRIKRTVETIGWKEYAEDYTKIVAAVVILVFINGYFHSYGWISIIIGVLTDILAFTVEYRGIGNIYRGYKQKINQETALEDTSN

SEQ ID NO: 598 - protein, 114 aa, Methanobrevibacter ruminantium
MVVQEHICINEEKIQEHSLQLKSLESDADFKDKRMDELYRKIDKIEEKLDVLNNNINNFLLRNSQENKKMEIRLTKIETDIQNQKLESQRRIARMGIALTAITILINIYFKIMH

SEQ ID NO: 599 - protein, 43 aa, Methanobrevibacter ruminantium
MREIHKYTPKSVEKTVYLNVFLGALIISQGFYSKTTIQQLSEN

SEQ ID NO: 600 - protein, 221 aa, Methanobrevibacter ruminantium
MKHRLNLDNKDPNYILLKEIFKIMDSRKSKSILASYGFKNLNRTIFTFKIIFISMFFGIDIPFILNELKSKKELRKYFNISEVLTADQVYKIFSEINSEKLIKCLNRILNSRNMVKRRGKKTFIVDATPVDVDINFHRNKKTKEHLEKINLKWSYSSSKGYYIGFKATVVLDYDSMNPVCILVHSGAPNDAKLFEEILENLQKRRIIRKGDTLIFDKGYYS

SEQ ID NO: 601 - protein, 171 aa, Methanobrevibacter ruminantium
MNEALTKLLDLMQDYNVILPNEFVSMARGISMIESVATTLDPKIDVMASIEPIVKEVMEERMNIKESLSNKKGSLVYYKNMLKTLPPLLTNSVHKINNGDMKLRFEIDRIDHIVSKFSLVVIIAALLMSSSITMTINRGPMLFDMPLIAVLGYIVTFILGAIAVANYIYSR

SEQ ID NO: 602 - protein, 268 aa, Methanobrevibacter ruminantium
MTTTEWLYQILLNLLDLSTIISIIVIIIAAAIIIKLGEKSLLRIEKKYEINLTAHYLLKDILKYGIIIIALALILNLIGIDLQNIILSLGIVSIVIGFASKDIVSNFISGIFVIGDKNVQVGETIEIDGRKGAITKVGFRNTTMIGMDNFKVTIPNSVLSTKTYKNFPMGEDYRLRLDVILPHGFDIFEYKQKMTEAMEKYEYINKDKEPVILAREINEEGSKVEISFWINDYKDRDPGKAVILEESNKLIYDYLMDEKNAGILRIVK

SEQ ID NO: 603 - protein, 313 aa, Methanobrevibacter ruminantium
MISKETFDKDKANFKGTYRPLLKEIDNPTLLQIDELHGIAGALSGKNQNIHNNILLLLASIGTIITIIFFIYFEWDISAFIIPCVLLMFILIGIHLVSNKLNYHDKYLEYRVLAESLRLQFFLSYAGAQEKVIDILPWFIEHGVPLVKEVLGTLDFTELPQKREIRDNWIIHQKKYHEGALQKSKKKMRTQKIVTYASITVTIATYIIALIFEYLIPASTFNLNGDIIHLGIKLAMAGMSAFTLFLGSYYGKMSLSEKIDDHERMVELYGIIEDRIRTEGETDEILSYAAREFLIENSTWYAYQSKNKPDLVV

SEQ ID NO: 604 - protein, 458 aa, Methanobrevibacter ruminantium
MEMNENVEMITGDPKKAINKLAWPLIASMLLIFLNNIIDSIWVAGLGPDPLAAIGYVTPLFMVLVGFGNGIGAGATSLISRYIGAEKRDDANNAAIHSAILSVVVSLVLTVIALLILESLLKLMGAGSVLKYAMDYGVIIFLFTAPILIPPIFGGAFRAEGDIKRATVPIALVAVINMILDPIFMYVFGWGISGAAFATGLAPCFGLCMMLYWIFIKKDTYLSYNRKDFHNNLNMYKDILVVGIPASLEQLIMAALAVTVNYMLTLVSGSVAVAVYTAGWRIISLGLLPAIGVGTAAITVTGVAYGAKKYENIRTACRYSVKLGLISSIIVCILLFIFADQIAYIFSYSEASAHLLPLIAGFIQLMCLFILYVPFGATAGNVFQGLGKGTTSFVLTTFREFVLVLVFAYLLGFVFHMGETGIYYGMLIGGFIGSVIAYGYIEYYVDRLIKGKVKGSDI

SEQ ID NO: 605 - protein, 190 aa, Methanobrevibacter ruminantium
MDFISTLLIAIALAMDAFSVSLTKGFTLKNLTKSQALWFGIFFGGFQALMPVLGWLGGIQLEWLITTFAPWVAFILLLLIGSNMIRESLSGDEEDEKDSDKFSFKELTLLAIATSIDAFAVGITYAVLKVDILIPIIMIGVVAFIFTIIGLYLGKKIGNYFGDKFEIVGGVILILLGVKILLEGLGILVL

SEQ ID NO: 606 - protein, 319 aa, Methanobrevibacter ruminantium
MSSTNTAVENKQEREEAFLKQTSKPSFSKTATEGFKQKDKGIKNPATKYNMPKKEETVDAKAKEAPKREAPKKEIKRESPKKEVKKEAPKKEIKPNIVKKSDEGSSGGINLKKIGIIAIIILIILLIAGIGLNQMQNQTTDEVMNYTDGIINFTYSGNWSVYNNTNADSNMTDLAFKTKDKTLIGFTTIQSDEITYEKILSDVNDTAHSLNGEILEYQEVNVGGVPAQEIIISTQDQGYSRYLCILHDGVYYCFVANNAKSDNQNLTSLNTTEIQNMINSISFKDVVAGDTANLDTSYQESSYQEESYDNYNYEDTSNY

SEQ ID NO: 607 - protein, 254 aa, Methanobrevibacter ruminantium
MIFAAIFAVGILLRDKIVHKLNFFVNPQNYLPEEEIQTLKQVYYLILILILVVCILNFFFDNNIILPNSPEFYVFNSFLDIIVSVYIAIIIYDGSKKSKILLIFLIPIPSIAFLLFGESLIEYWDFVRIPALLYIMKIFYDKFHIYTDKYNLEKSILLLFSIVFISFIITLVAENEDPLNALVMVSNAFTSKGYTILGESTIGKIDSIFLVWGGYIISGAATATLTAAILIKHFNAKIEKFDEKFEELEKLISE

SEQ ID NO: 608 - protein, 139 aa, Methanobrevibacter ruminantium
MYLEFWIILAIILIIGELLTGGFYLLSIGLGSLAAAIFNYFQFSITIQIVAFILVTVIFIILSRPLFNRLNRNTIDKKSNTERLIGLNGEAMEDIGQKNIGAISIKGEVWKAISDEEISKGEEVKIIGIDGVKLKVEKL

SEQ ID NO: 609 - protein, 322 aa, Methanobrevibacter ruminantium
MMDLIYILIIIIIAIIAYKSIKIIRPYEKGVVERLGKYNRTVERGLNIVIPFIETIRKVDLREQVVDVPPQEVITKDNTVVVVDCVIFCEVIDAFNAVYNVVNFYQAITKLAQTNLRNIIGDLELDQTLTSREMINTELRETLDVATDKWGTKVVRVEIQRIEPPKDIVEAMSKQMKAERMKRATILESEGYKESEIKKAEGDKQSKILAAQAEAEAIKQVADANKYQEIAIAEGKARATEITYNAIHAGNPTNDLIAIKYLEALENIADGRATKIFLPTEVSGILGSVGGIAELFKDDPEALEKFESIKVLENAKETADNE

SEQ ID NO: 610 - protein, 129 aa, Methanobrevibacter ruminantium
MGGEKMAKMNAVILGFILTLVVYLFFGRYEFWGLLIVGFIVGYIAHEGILGGMWNAALAGAFGTIISAILFIILVTIGGTAMMGFLGGLAGFTVSGITSLIDIVFTIIKYMIVMGITGAVGGALSGEKE

SEQ ID NO: 611 - protein, 170 aa, Methanobrevibacter ruminantium
MVDAEKAKQPKERKNKNSNLPDIDFKALIFGAAAYAFFPLVAYQYNLDILMVFAAIGPLYIGYTAKTELKSIILGIVGATPLLYLAFSGMLGSYGSGEMADIIMTVGILGLGALMGYFGGYLYRDRQRNKAKAGGIVVEDTPKKEKQFEDTGSVKKNVANLFLPKSRRKK

SEQ ID NO: 612 - protein, 416 aa, Methanobrevibacter ruminantium
MAIGVKEIRITDTISVLLLPLIYALIMGLALFLAKPIKFIGKKQSKVAEGAMVLFIGVLIAKLAISSGQSIDIIFNVGPSLILQLLGDLGTLIALPVALILGFRREVIGMASSICREPNLGVIIDKYGFKSPETRGVLAIFVIGSIIGTPFISFLSSICISLIPYHPYAFAMASGIGSASMNAAALVPLVHMYPAMATQLEAFAGCSNILSFCLGIYMCIFISLPLAEKLYKWLSPIIGKGEGRTIDDEYAIEGVKDDKYATSEDLSSGKIERWVTFLVLFSIIGTVGNFIGYHTPLLDVFIGMLIISIITLIGMCLERIIPWDIPSIIYISLLGIFLAIPGVPTSDIIITYVSQIELTTICTAFLAYVGIAIGNDWEEFKKIGWKGIIIAIIVISGTYLGSASIANLVLFVTGMI

SEQ ID NO: 613 - protein, 352 aa, Methanobrevibacter ruminantium
MKHRLNLDNKDPNYILLKEIFKIMDSRKSKSILASYGFKNLNRTIFTFKIIFISMFFGIDIPFILNELKSKKELRKYFNISEVLTADQVYKIFSEINSEKLIKCLNRILNSRNMVKRRGKKTFIVDATPVDVDINFHRNKKTKEHLEKINLKWSYSSSKGYYIGFKATVVLDYDSMNPVCILVHSGAPNDAKLFEEILENLQKRRIIRKGDTLIFDKGYYSYKNYQIGISKYKIIPFIFPKEKFSRTRLDDILTYPLAVFNKTKRIMKEKRLYNSLKMELMKKIDSWEKFKPIRGKIEDFFKLLKQGLNMREIHKYTPKSVEKTVYLNVFLGALIISQGFYSKTAIQQLSEN

SEQ ID NO: 614 - protein, 104 aa, Methanobrevibacter ruminantium
MFVISLIPYLTIFVANNPNSLLSESLYGLDFILVDIILFIMSRYLIKINENSEYLSEVLDLKNAIIIPFIFLIIGFIIGFLGYPIAISIVCLITIVRSILYSIK

SEQ ID NO: 615 - protein, 75 aa, Methanobrevibacter ruminantium
MKMENLMETNRLEAFYDAIIAIIVTVLVLELPQPETATIAGILALKVSYFTYLVSFLVCQSLAISPLDICSCEKN

SEQ ID NO: 616 - protein, 157 aa, Methanobrevibacter ruminantium
MSIIAIFLGIIVIAFPLLGIIAASDILGLSVLLLSIFLLLNGISEVEYNTTKGLLNTIIGLIMLVVSLGLIFNPSIFSFLTAITIYLAGIFLIIIGLVVIVGNRENKYKFWMGIIGIILGVIYIILGTYIHNSFVLGSLIGIWLVATGILNLLSDGY

SEQ ID NO: 617 - protein, 386 aa, Methanobrevibacter ruminantium
MNANPKILLYILMISALGINTPLSIVGIISQIAEYFNTSIAISGLYVSSFTFTIAICGLFIPVLFSKYNRKRTFVSILTVFAISNIAIIFTKSIYIASFFRILSAIFYPAFISIALTVCEEIAPKGEEQDYITKILLGISIGSIVGLPITTGLGTIFNYQVAMSWIFAINLLSLILIIIFFPKIKGKAKSYEMPFSSLKSKEFLLATIGIMMMPIGASIVYNYQPYFLQVVSHVYTYKLSIFLFIYGLFSIFGTWLGGKLIAKRDKATILIFQLICGGVFVLLYLFANYLIPVLILILIFGILDGMGYNLIQYIESSVIPDSPELANGVFLSILNGGIALGIAIGGFLVDGFGIMSIFIFGALFLLLAFIILYYIIGIMKMPLKYS

SEQ ID NO: 618 - protein, 118 aa, Methanobrevibacter ruminantium
MNINGDLMNKKITVDILMFIAIIVEFLSLPILIHEIVGVGLLFLIALHLKYNKRYFKTIGKGKYNLKRTLNLIINIGLLASLLITIISGIFSSQKSLKGMKIGNHKISHIHKSSSYLV

SEQ ID NO: 619 - protein, 247 aa, Methanobrevibacter ruminantium
MGPDFIISIFKGGAESLNTSMNIFFTDLIIIAFIPSLYIASKIVKDRPFSSYSSSRGGWNFRLYFKALAIPVILYIIYLGAESLILGSEGTSHFSIAFLAVLLISVPLQCIAEEYIFRGIIMQTLGSWIGIPLIAIVIQAIIFTLGHGYDALGLLETLVLGIAYGFFAWKTNGIEISSALHTANNFSLGLFIMLGLEASNSSFQLYDKIGGIVYLIILCIIMYYVGKKTDWFGEIPEDSQNIGLLNF

SEQ ID NO: 620 - protein, 327 aa, Methanobrevibacter ruminantium
MAGLISGIVALFTSWLGVSGTVIGSVFSSFLYQFLSSYSAEKYEERVGEGTSRKPRNIGSEIVYIFPIVVIVIIEVIFILSDMHYVFDKIFDILEYGIFQNNLFRLMGLGLIALGVYPLLSSTNIEKINGEIVLVAGIYLFIRGMVDINDLTMQVHNMFFADFDFFIAIIVVLALVFVIFNVLRNSTQEYFNKEDGDYDAVNDEFTQKRFSKPRRKSKARKIDTSSFHKGQEYKEHYLNSDFNDKGHNQSPNPDSNMDDYHNDDLNNYQTPQEDLPIYEEEIIYLHNPEDPNNPIKKRILKRVNPDSHYDDDYDETYIIDDAKNDNF

SEQ ID NO: 621 - protein, 263 aa, Methanobrevibacter ruminantium
MKKPGILNKITIIDILIIICIIGAVGFAVYHMVDDDSTKASATSFDYSTNNKMLETYMNYYKDGKIVTSSLIGTKSNTGEKIEMNGTVLWLGDNQNDKVNIEINNDGKPILAGFYKDTPNADVFIEQISLETNGDSYANITDFVVSPKEIKNLKEIISKIPNDTEYEISTSIAIDDLDSVTAQKLANALNKNKKPCIVLKNSGTVILEVNRANQTDFEIADNVLGDFKGQTSEIQIRIYNSTAQDSIDIQNAFNVLSIANTSH

SEQ ID NO: 622 - protein, 418 aa, Methanobrevibacter ruminantium
MEFIENQWVNSYFKGLYPSERFLSIVNKSKILKEEIFSPLIVLVTFTLFILLATDPVPRDLQTTIIIAFLSFFIGAIIFPRFILNNQLNQLNDETNTDNKESKTDKSKQIPLFNSYDVYSIGFCLSLIGIVFLFLSIASVGGLPILKSSLRYSLKPAFTMPVFLIIPGIGLMASHYLNQYKNNEISRSQTRFRFLVLTAIGIGTVLTLQYRTPIIAILLMMIIIGYYGKILSVWEVILGALLGVCAIIGIGYLRSLNELAISSNTNIFSTLNSRANFTMHVLNLLNYISGNFGLMHGKMIASAMPGSDLGPRMMVGKLIAWRTEVTVTPTLLGQMLVDFGKLGVAVEMCLLGFLLGTGYKIVKITENSFYIALYGLILTYSIVGVETGILDIQILAYFFISAFIYFAVILKDKGIRIY

SEQ ID NO: 623 - protein, 276 aa, Methanobrevibacter ruminantium
MAIEEVRNLEVIASKDTIIHNLEGRVKLIAILLIIVFCVFSDRLIVPLVLEIFLLIVMYLAELSFKDSFKRIALLLPFGGFVIAFQPFIHPGNIIWQGPYPWLFITDTGLNWTVLLFARLIVCLTAIVILSSTSPMQEVVQSFRKLGMPRDLAMILTIMVRFLFIFVDELRDIRQSMKSRNFDPFNKKIPYKWRVKQVGYSIAMMFLKAYEKGETIYLSMASRCFSDNSRLYHAKTIIGKHEYIFLACVIGIVIVLELVVLFYSGNLDYLGVSLSL

SEQ ID NO: 624 - protein, 189 aa, Methanobrevibacter ruminantium
MIIALYFAGKWAKANLDEKRIPLLAVLAAGIFAIMSMNMPIPFGTSGHMVGGALVAIVFMAPEAAVLVFTAVLLIQALFFGDGGITALGANVFNMAIVGGCVGLYTYKGLNGIIGKYPSIFLGAWLATLVAAVVCALEMAIAGTFPLSVGVASMALYHAFIGLIEGVLTVIVIFALEKYRPDLLAWNRE

SEQ ID NO: 625 - protein, 671 aa, Methanobrevibacter ruminantium
MANLKIGLAGNPNVGKTTLFNNLTGLNQHVGNWPGKTVAQAKGSYKHSGNEVEVIDLPGNYALSAHSIEEIVSRDFIVDEDSDVIVNIIDAANIERNLYLTVQMMELGANLVVALNMNKYAQDKGYTINADKLSELLGVPVVEIEANSDIGKEQLLKTIEQAAANPVDSSKKLVYNNELKEHLAELQAVIEEDKNLLDVPSSWIAIKLLENDEIVEEKIEGSSKRNNIVNETQKVKDHLKGIFGEGSEEVIANARYAFIDGLLKESLTKPDHLKTTISEKIDRIVTNRILGFPIFLVIMYAMFEIVFTFGAPFQDLIDEFFGILGDAIIGSLGETMLSSFLVNGLIGGVGGVLVFLPQIILLFLIISFLEDCGYLARAAFVMDKLMHKFVGLHGKAFIPMLLGIGCGVPGIMATRTMENEKDRLITMLIVPFMSCSARMPVYLLLVGAFFAANESLVIFSLYLLGILVAVIVAFILRKTTFKEMDAPFVMELPDYKLPTIRGIIMHTLEKSWGFIKKAGTIILVASIVIWMLSYFPAGVEYGSADSAIGTIGQVIAPVFAPLGFGEWQPAVALLFGLVAKEVVVGTFSSLFGVAEEGAEIAAAMHGIFTPLTAYVFMVFVLLYIPCFAALGAIKQETGGWKYPLLMAGLTLVVAYVVAFIVYMIGLGLGLG

SEQ ID NO: 626 - protein, 92 aa, Methanobrevibacter ruminantium
MVDRHEIVDKMYENKHTLLFVGGIATAIVGAKILKSQTTKDYAAKGMAKVLTCKSDLEESIQDIKDNAEDIQTDAKAAQKEAICVDVTEEEE

SEQ ID NO: 627 - protein, 135 aa, Methanobrevibacter ruminantium
MNNQDYDTGISSEVFTVKSNIKLIDIFNLILEKKARAVMDLFDSLTNKETIHNESSIIIIGTYFTGIAIAKYLSYNGFKNITIVDIYPHLEGFIDSNLGDPIDVNKSSKGKFKENIEFSSDLGLIRSADVVIDTT

SEQ ID NO: 628 - protein, 202 aa, Methanobrevibacter ruminantium
MFFILFALFILYLPKIRHENDYSSISKELPYALRQLSTELRAGKSLFDALDSIVDSDYGVLSREFSRVLEEIKYGETSENAFLNLEKRVNSKALSRVIYEILASLRIGRQSCPIQLNIIAEDVNFDMRMKLKEYSEKLNAFIMIYTFLAILAPVIILTMLLAASVVIGDIVPSSLLFILYGLFFPMIIVFLAFAIKKLEPKL

SEQ ID NO: 629 - protein, 416 aa, Methanobrevibacter ruminantium
MFDLLAACFIGIAIGTGTGMVPGIHVNTAGAIMFASSGFLLSFLSPEFLCIVMVSMSIAHALIEFVPSMLLGVPEEGTASSILPGHRMVLEGRSKEAIRIVSVGGFGAIVVVILMLPIFAVALPFLQDLSKPYTWMILTVVSILMIYKLSNGRLAFMWSILLFVLSGILGWIMLQTPISSGISLMCTFSGLFGISTILFSLNDSSSIPHQNKYYDFVIDKDTIKSIFAGGTAGAILGFLPGFGPAQGSIIAQGVCGTSADGDDTKNFLLANSGLNTSDTLFSLIAIYLIGNPRSGIAVYMSYLISEFTLSHLMIFTFASLIAVSISLIICLKLGDGFSNLMQGVDYRKLSISVILLMIVILYIFAIIYEGPILYLTLALITSTAMGLLPHYLGVSKSHLMGVLILPAIIIYMQMFM

SEQ ID NO: 630 - protein, 611 aa, Methanobrevibacter ruminantium
MTTIFYFALSQTFITQLGLGSPQIGLLYVFGLLFGPFGALGASLSNVAIDVYHGYTFVQILPSAIISFGVSLLAYKLWYSGFKSDEYTKPRLDTIYHLCLFLASIIICGMIYSVGHGNLAYILISPDIEESIIIPSFLNFTNVAFIMGIAGIWLFKRTNLIETPKKSERRLNKNLYRLIFSLLMVMTIVSFIFIIRNSDNLTIITGLIIVVALMYAYMTKPFIHEIQEVNENSIIAKIVRNFIIITLILGFFGGLVSIASFDYVETSITLNIYLHLMPILVISDIIIILFFIPGIIILKYIGDNVVKPITSFSEIEGFIKEDEKIEAEGLIKVYSEYVNEQNEIGTLARSYTELINHNNNYIENIQKIEGEKERTNAELDIATNIQAAALPTEAIKTDAFIVNGYSKPAKEVGGDFFDYYELDDGNLAIVIGDASGKGVPAALVAMITQVVIKQTLINNHDPSEVLFSLNNQLCVNNPESMFITLWLGIYNKTNKKLTFSNAGHNPPLIKENGKFKYLDIESGIVLGIMEDFQYEDEEITIDGELVTYTDGITDANNNDGEMYGEDRLLEFFNKFKSDKDPILPLLKDINDFTKDTEQFDDMTLLYLKVND

SEQ ID NO: 631 - protein, 347 aa, Methanobrevibacter ruminantium
MSKNRIEWIDLVRALAILTVLYIHATDGIYIISSDLIPYWTPFSRVFQFISLFIGRIGVPFFLMITGYLLLDRTYDDERVKKFWNKSCKGLVIVTIIWSLIYAVSIQLVAYSSIQVNTIEAGNLFFSHMWYMPMIIGMYLSMPFVANALKNFDPRTINQATIVFSCLAFLLPFISIVCEMQGLQNVNIQYCLGFSGGVYGIYIILGWLVKKGLFKKYSSNSLRLLAIVSFIICVLFQWYAFSIDFSFSLWYEFPFILTGSFALFELCSRREKVRGFRGVEFLAKYSFAVFLIHNLFRIILLPMVVYLPYTEPVKAIILWILLIITSYAAAVIIYRIPKFGKFILYMR

SEQ ID NO: 632 - protein, 236 aa, Methanobrevibacter ruminantium
MNYLNQNYATVFMGNDFLLIIASLIIMIFIFGYGSVITKDVIRGGKKLPKIYIKECTIYGIKCVIVALIYSAVQTLVMVDLSHRFLFPEFELEHALTDITGTLQMFTANNPILIGEYVVISIILTYIFVFFMEISLARLADGGKLLESFNLLAIKRCIDTIGWKKYTIDYTKLLLAITILTYLQYGFQFLGFFDYITDLIFGLLVFIIQFIGIGQIYKIYKIKKYSNLDRPTKKSV

SEQ ID NO: 633 - protein, 301 aa, Methanobrevibacter ruminantium
MLLELIIENLLETIASIIVFLIPLGIGKYIMNKIKKHESKFTNNRLLNPAEYMPKEEVETLKQVSYLIVLFLLFIFFIYSFWPMANMKFFSFLEIVLMVYIALNIDYSNWKNKVLFFFLVPYGSIAWFLFEELTNSLFDIFHMIILLYFMKVYYEKFREYTETNGLGITILLLFTIIFISFILTMIVEGVSPIDSIAMVSNAFTSNGYAVLGSSFGGKLNSILLVWSGYILSGVGTATMTVALLSKHFNKRIKENEKTNEAQYAELKEMIERNNEEIKEILKENNLEKKTEEELEKKIIEP

SEQ ID NO: 634 - protein, 198 aa, Methanobrevibacter ruminantium
MLESLRPFLTKILEPIASRLNINPNIVTIISPFLAIISAYFFATGNLIGGALFILLSGFLDVVDGAVARYHNRSSPFGAFLDSTMDRFADAIIFIGIIFGGYCNWFVGVLAIHSAITVSYVKARAESQGVECNTGIAERAVRLIILMVGAVIAFIFNSDIIFTYFIYILVVLSYFTVGQRVYHVWKELNKKKIPQRRL

SEQ ID NO: 635 - protein, 125 aa, Methanobrevibacter ruminantium
MSFCPNCGVERKEGSHFCHHCGYDYREANSSGMGSSSSSDSQVNQNPSFNSQVNQSSTYNVPTKQNPHNFAKITGYILSFLIPVFAIVIGIYLILSKNEEVHKHGIIIIGISIVVQILSMIFMMG

SEQ ID NO: 636 - protein, 173 aa, Methanobrevibacter ruminantium
MITVIVLEIPMAVDGSWGALLDIKLEFIVYAVSFIVCFNFWNYNNNVFSMVNKIDHKVIWSIGIAMFFLSLIPYLTTFVALNPDAFLPSFLYGLDFIIVAILTIFTINALKNSDKANIALQIALADNQPYVTTIVFVLFGMIVGYFIYPLAIVIACLFSIITLWLISYYKKHG

SEQ ID NO: 637 - protein, 188 aa, Methanobrevibacter ruminantium
MNTNRFETFFDAIIAIIITVLVLKLSQPAAPTVPAFLALNARFITYAICYLALFIIWYDNHNLFQVVEEINNTVLIIYAIQMFAISLLPYFATWVALNVNSIAAETMFGIDFLAILILYVLSIYAVYRADPYNCGISKNNFRKIYCYIPIIIVLIGIFNKLYSLYSRNICLHSDCTDLLAFLFKTSKT

SEQ ID NO: 638 - protein, 208 aa, Methanobrevibacter ruminantium
MRDCSNCNRESCLLQKVAGIIMVFGSLYYILAELISAGFFNDSLINTYLFHTISELGVPVANSPLSFLMNSAFILIGITLLLGYFAKFRDFIIKYKLIISILAVITALGVIIVGFIHAGNPLTDGYHSLGAVMAILGGNVMLILVSRAMAEFESYQKITFILGIIGFIVFWIMFFNLESLYMPVFERLSVYTLIIWNFMTGFYLYKNS

SEQ ID NO: 639 - protein, 115 aa, Methanobrevibacter ruminantium
MKCPVCGCENPDGYKFCHDCGNPLIMPDYDEMNNDYPSFDSKKLIIIGYIIAILFGWGTFILSAIFGSYGFIGFIGLFFPGFMLNSKDSNIRKHAYIQLAIMIVGILATFLVLFR

SEQ ID NO: 640 - protein, 241 aa, Methanobrevibacter ruminantium
MICPECGAENQDSAKFCKQCGTSLNPVATMKKTNSDESRPIKSGIFNENNSSPSSFEAKGSGGDNKNLIIICLTVIICAVLIAGGLIFLSNGSNNGNDSSDVGNSISLPDNSVNQTDDSQNQTDTEPAPKKSSVSDMKILSGSFTTGSSLSDKTWCSVYVGEKYAGEDVKISVLYSRDGSDLNQGKIVPKNVGSDGTVSVPSADAFKYYPDHALVTIYDSNGNVLDTQEVIMSAKSGTQTF

SEQ ID NO: 641 - protein, 59 aa, Methanobrevibacter ruminantium
MNYQEELSDFWKQCKRVLKVAKKPDREEFFDFSKVTAIGIAIIGVIGFVIVLFGQLLGL

SEQ ID NO: 642 - protein, 293 aa, Methanobrevibacter ruminantium
MGKRGYMGNLYETVRGGTPRAVGIVPFILISLFMPSGFNNLVLVMGLCALIDDIIGRKTIANLPIEIGQLARGIGMLCVIGLGYPIMGVSSILVVLLIQPMNIADMQPGTAAATTIIMSFFTLLAVVIMQVGPVLEIHPYYYPLLVLVTCLAYCPLDFAGKIMMGEVGNHTFAISLGICFYALGGFIGTLILFIVTTGLIAYLRRYNLSRFLINKLHIPNPTFGDLFMDVLTGGGLGDLFRKILLKSNQYDVDNEILIALGFRRLLYNPYSPNLEKVVQKDSRTKRADLRRFY

SEQ ID NO: 643 - protein, 521 aa, Methanobrevibacter ruminantium
MIKQTLGLNVEDKKYYLKLIIEAVLIGLFSGFIVSLYRLGLDHSESILSYILKYIQGDLTLIVLWFVILAIMGLITALLMKWDPDSLGSGIPQVMGEVKGYFDVTWWKTLIAKFIGGTLTALGGLSLGREGPSVQLGAMAAKGVSKYLPNSKTDEKRLLVCGSGAGLAATFSAPLAGFIFTLEEINKGFDRSIVLVGLVSAVVAVLVSNVFFGQSPIFPFTSLNLPLEYFWLLIVLGIAIGILGYIYNVGMIKAAEMWDKLSFLPLEIKFIIVFLVTGIVGLFLPEVLGGGYSMMHLIELSLPPLSVLIVLLIGKYLLLIFCFGSSAPGGIFYPVLVIGAYIGAIFSAIVIPIFGLNPLIAYKFIMISMAAMFASSVRTPITAVVLIAEMTGVTNSIVAMIVVVILAYIIPTILDNDPIYETLLMRLLKKNKGIDFDKTKSVLEEYVVPMDCALIGTKIWELPIPKSAMVVSVVRSGNTLIPDENLELKYADELFIIMNQNTYPEDNNKIESLIYNNWKEE

SEQ ID NO: 644 - protein, 232 aa, Methanobrevibacter ruminantium
MKEALMINWGYVVLLFILGAISYKRKSLDMLGALIMIFMGITIIFSAGVSWFILIVLFFILSIMATRFSKPYKKEIGQYEKTRTAKNVISNGLVAFLMAAFGSYYLPLAGGFIGAVATATADTLASEIGVLQEPRLITSFKKVPAGTDGAISILGTSAAIVGAGIIGIASFLLGIMPDPLIAIKISVISGTVGCFIDSILGAVLERRNFINNEHVNLLATISGAIIGIISVM

SEQ ID NO: 645 - protein, 352 aa, Methanobrevibacter ruminantium
MKHRLNLDNKDPNYILLKEIFKIMDSRKSKSILASYGFKNLNRTIFTFKIIFISMFFGIDIPFILNELKSKKELRKYFNISEVLTADQVYKIFSEINSEKLIKCLNRILNSRNMVKRRGKKTFIVDATPVDVDINFHRNKKTKEHLEKINLKWSYSSSKGYYIGFKATVVLDYDSMNPVCILVHSGAPNDAKLFEEILENLQKRRIIRKGDTLIFDKGYYSYKNYQIGISKYKIIPFIFPKEKFSRTRLDDILTYLLAVFNKTKRIMKEKRLYNSLKMELMKKIDSWEKFKPIRGKIEDFFKLLKQGLNMREIHKYTPKSVEKTVYLNVFLGALIISQGFYSKTAIQQLSEN

SEQ ID NO: 646 - protein, 229 aa, Methanobrevibacter ruminantium
MLWTDFIVLAIVYIYVVAIFILSEKVLKSRPEVSRKFLHIMVGNMIFAMPFFSDPWIMLLFITLPVTVALFFLTEYSPIQIENSVTESGHALGLLFYALIWSILLFVYPIMLDPNYLWIVAMAIVPLVYGDGFAALVGGKWGTIKYHVFGGEKTVVGSLAMLSVTAVLSVFVWVFYSSIGYTLPELNLWYILLISAVATLCEALSYGGVDNLTVPAVTSVLYYIVATVL

SEQ ID NO: 647 - protein, 208 aa, Methanobrevibacter ruminantium
MNIKELFIESLKDNKKLIIGLYAFFIIVFIAAWIITGPKMQAIASNVTAMNGPGGAQSSAIELFIHNELGGIITYLASVFFGIAAIVLLGYNALNLGSIGQLFNHFMPNGGILYLIYLIPHGIFEITATVLQSAAGILLFLFIWRFIKAFRSKDTNGASDAFEMTKKTLIQSIVLMVIATILLLIAAPIEAYFSTAFSEFIMGFLGLR

SEQ ID NO: 648 - protein, 344 aa, Methanobrevibacter ruminantium
MKYLFLLFGGLDDIYLLLLTILFGILNMVPMFFEEKKSRPITRLLDTISGFWIWMSLFYLFVILIIYIGGVYIDWPFYIIVILVLLVPLLTVYSYFHAHKIIIHERTIQMDNINEDINIAHLSDVHFGSTRHDKIIRDLSDKLKELSDYCDLAIISGDIVDGSSAIEEDDFLPLKDVNMPIVFTPGNHDSYLDIEDVFGACRNAGIIVLDDEGMEFGNLNIFGMTFIFGMTRKFEEFEVVSTGVLGDFVKEDKVNIIIFHVPKNWEDFSKLGFDIQLSGHTHGGQFHPLTWICDLIWYNRGLFKANIGGKDRYLHVTTGVGSMDYPFRWGTDSEIVVLKLRKND

SEQ ID NO: 649 - protein, 282 aa, Methanobrevibacter ruminantium
MILNLILIILIALIIIFSIILYNGLRIILTVEKEKAEARYKLKITLLKIPIFTKDSSEDKATESEEEKEEDGEEEESKDKKGLMEKYNEIKPILKELIKSKKELKKYLKDILKSIDIKKLEGHLILGLSDSFTTVKIASWIWSIGAIVNSKKPVSLTVDPRFTEIITDFEGQLELKINLLKIIFYSLILVSKKDIRELIKVIYAYKKAKDKENEEKENSNEELYKKEKDTEIKENSKEELYKKEKDTEIKENSKEELDKKEKDTEIKENSKEELDKKEEKET

SEQ ID NO: 650 - protein, 618 aa, Methanobrevibacter ruminantium
MDDETNNNQWNSSTSFILVMVGSIIALAGIWRFSYLIYENGGGSFLIPYILAIVIMVIPLLVLEFGVGFKYKASLPRIFYNIKSEFEIVAWFILFLIFIVLICYTCIMSWDLIYIVLSLFKGWGNNPSVFFTTTLLHSTSNPYGLTYLVVPIGIGLILIWALIYFISRREINRGISLVTKFSLALTFVLVIILSVFALQLPGSRTGLMALFNPNWEYLLDYNIWLTAFGQLIFSYGLAYGIASTYSSYLPEDSKLIDSAWVIVLISLIFEILMSVLIFALLGHMALGKNMPITSLVSDSFSLIFVVFPNVFNVMGSWATIIGPLFFMVIFIGGLGALFALIEPLANAICEKFIWTKDRAIKTLVLAGLFASFIFATGMGEYFLRIVDGFITQFAIILVVLVEILVFGWLFDLDDIRNVLNNNSRIKLGKYWVYLIKFAIPILLIVIWILGVYNLIITGDRQSLLVQSILASIIVIVPLALTVAPFNGEYSLGSITGGYNYFRDSGDDEEAKSNSKPDLKSRFTSRFTSKDNDVDNGTEGYEEKTYVEKTIDDYEGYDGVVAITDDEEENSSLKSRFSWDKFKKSKNGKNVLNNVDLSAKEFDPPSDDDYDDYETYKLV

SEQ ID NO: 651 - protein, 443 aa, Methanobrevibacter ruminantium
MANSNQSEWDSNIAFILAMIGSAVGLGNIWRFPNVLYSHGGGSFMIPYIVSLFLLGISFVLVEYAVGYRFKSSLIKVLYSVKSKLEPVAWFIALIVFLITTYYICVVGWDLIYVVLSFTKAWGSNPDLFFSSIVLQSTDSIEGLLHIVPMVFISVLALWAVAWYIIQKDLNDGIGKVSKLLLPLLLIIVVTIVLFSLTLPGASIGYTQIFTPDWSALTDLNVWLAAFGQIVFSLSLGMSIALTYASYLPEGSKLTDNALIVAFSNSGFEIFNSIGIFSILGFMTLNTGIPFDQLVTEGTGLAFVVFPKVFNIMGPWATIIGPLFFLCILFAGVTSVMALLEVVCYSISEKFNFSRRKSATIVCIIGFIVSVIFTTSAGSMILGIFDAFLNNIALLFAVLLECIIFGWIYNFDNLIETLNNNSNIKVGKVWKNVIKFILPICIC

SEQ ID NO: 652 - protein, 564 aa, Methanobrevibacter ruminantium
MNLDSNVKTGLIVAISIIFLFVLSLFITSAPTGVDNSARFGILTLLPPLIAIALAFITKETILSLFVGVFVGEFMVSVSDLNIISSAVNAFLAMGGQIISCMADPWNAGIVLQCLLIGGVIQLITKMGGAKALADALAKRADTPRKAQLITEFLGLCVFFDDYANSLIVGPIMRPVMDKLKVSREKLAFVVDATAAPVAGIAIISTWIGLEISLITQGFESIGMNVSGFGIFLQTIPFRFYNILILIFIVISAVTLYEFGPMKEAEKRARARKADEPVKSLEATSFDDVKPVEGIKLSVWNAIIPIAVLIIGALIAFYWSGYTTILGGEDQALIHLMKTSPLSFNGIFEALSASDASVALFQAALLASIVAIVMAVLQKILTIEEAISEWIGGMKTIVITGVILLLAWSLGGVIGDIGTADYLVGILKDTIPVFILPTLIFILGALISFATGTSYGTMSILMPLTIPLAWAVNPDMGFVIVCTSGVLTGAIFGDHCSPISDTTILSSMGTSCDHIDHVRTQIYYAIFVASISIIFGYIPAGFGIPWYISIPVAIVVDVSLGLRR

SEQ ID NO: 653 - protein, 900 aa, Methanobrevibacter ruminantium; identical to SEQ ID NO: 330

SEQ ID NO: 654 - protein, 515 aa, Methanobrevibacter ruminantium
MIIIGGLKNMNETIKENSWVPLIVVALASFIVALDATFMNVSISQVVVDLNTDVSTIQSIMSFYTLITAAFMLLSAKLQDIVDKKKLFLIGTALYGVGTFTASISSSAGMLFVGWAAIEGVAGALMMPATVSIISGTYSGEKRTVALAIVGVMGAVAAAVGPLFGGVMTTFLSWRYGFAVELIIVFVILIFRNSIPHFEPTESRSDLDISGAIISFIGLVLLVLGILSLSKDFTTSIGIIVVGLIALVAFAYFEIRRKRNGKVPLLDMELFKDRNLRVGTIILLLSYLAMGGGLFAVSLFLQSVLQLNAFNTGVTTLPLTLGLLIFAVLAPSLTEKLSHKKIMAIGCIMAIIGCLMLSYQFRLDTTLWTLLPGLLVLGAGLGFIMALCTDISLSNIPAESQNNASGVNSTGTSLGESMGTAVIGIILILGVMGGISTAVDTYAPDHSGDEQFQLEVANYFQKVATIDDLKQDSTLVDVANIIIQNTMAFVMQVTALIMGVVFLLTLRLKDNKIKQ

SEQ ID NO: 655 - protein, 153 aa, Methanobrevibacter ruminantium
MEPNKVSGILSIILGLIFIIFPLVSSGLVSIMIGVSLLFLGIASILTEFSALNIIIGILAIIFGLLFIFNIDALSFLLGFQFYIIGILMILIGVAGIFAGEGVSKIASILIIILGVIALGLGGFSLTQPIFAAVLIGVALITQGVRLYVAPKN

SEQ ID NO: 656 - protein, 279 aa, Methanobrevibacter ruminantium
MGVNMEIMEIIKDSFLFPSKNLGTFSIYVVLSVLVATFTFGGIFSYLLGFIGSEYILIGGLTLVFAMLIGWVMSGYEISIIKSGIDLDDEVPEFKWWDNFITGFLNFIVAIVYFIIPAFIVGVVGYLININDKLMAVAQEISSLYPNIFLTSSPDIAFEALSQAIIELIVPLAILIIVALIVFVIFLFLQSMAEARLANTGSLSEALNIFEAAKDIKRIGVRKVIIVILLVFVIIGVIGMVTSVIFNYVPTLSILSIIISPYLVFFAQRATGLLYSDIA

SEQ ID NO: 657 - protein, 654 aa, Methanobrevibacter ruminantium
MEIIKGKEIPKKSLKRSLIVFIGNMIGIYLISILGLGVEISQTGDIFLLVLFLGIVNAILWPILTRIAMPFLVLTFGIGSLILNGLLLQLLAPSFGIEIKGAAMILAPLGMAAVTTVLSSLITINDDSSYYRSVLNDAKKNAKNEVKDYPGVIIVEIDGLAYNVLCEAVEKGDMPTLKKMIESEDYNLRMWETDLSSQTGASQAGILHGNNEGIVAFRWIEKSNGNQMMQCSGISNVPELEKRISDGNGLLVENGASRSNLFSGDTDNVIFTFSKIMDFGKLYNKAWYSVFSNPSNFARIVSLFLADIVREIWSQITHSIKNIRPRINRGIAYIPTRAATNVFMREINTSTLIGDMMVGDVDVAYSTYLGYDEIAHHSGVRDSDAWIALRQMDQQIKHLTDANKYSPRDYQFVIQSDHGQTNGATFTQRYGQTFEDFVKSLLPEDMTMFAKMTSNDDHFVGDYTPFARKDKKIEKEKEEAKELSDSEVIVLASGNLAMIYLTQWTNRLSYEELNSYFPELIPGLINNEYVGFILVKSQEHGDLAIGKNGTYYLDRDEIDGENPLLGFGDNIVKHLKRTSSFEHTPDILVNSFYDEEADEVCAFEELVGSHGGAGGDQSKPFILYPSSWNVSDDEIIGAENIYKLLKENLAELKK

SEQ ID NO: 658 - protein, 267 aa, Methanobrevibacter ruminantium
MEIFKVVCELIIPILIFGVLFAVGKFIHVRLLNSKSRILNPGEYFPDEELETLKQVYYLVMMLIFFAFILYIMIVQANEVFAIAVLQILVSVYVALTLDYSYLKNKILFFLLVPFEAIIFLVFNDFLMIWPIYLMHILVYAYFIKVYFDKFRKYTETNGLGITIILLFAIVFISFIITLFVEGVEPLNSAVMVSNAFTSNGYAILGNSGIGKLTSLVLVWSGYIISGVGTATLTAAIMMRHNQKREKELNKRLDELESLIKNSNNKE

SEQ ID NO: 659 - protein, 275 aa, Methanobrevibacter ruminantium
MDLLFYVVLLLIGGCFAGFMAGLLGIGGGIVITPIQYYLLTSIGCDPKTSLTVTFATGLAVICVTMINSTRKHKQNNLIVKQHLKPMMVFGFVGAILGAVISQYIDVEVLKILFGVICIVSTVFLVLIKSPTSLDNIKTDAGLFYSIAFACGLASGLIGPAGGAFIIPIFVAYLRYPITNTIGTTSALSIATTLAGVICYIVLGWGVQGLPDFSLGYVNLLQFVFLTITSIIVSGYAANLSKKINPTKLKALQVIVISYIGLQMMGVFDIILSII

SEQ ID NO: 660 - protein, 110 aa, Methanobrevibacter ruminantium
MNNIAYLLLAILFETSATSLLKVAEGFTKPLPTIASIILYILSFYSLSNCLKTAPIGVAYAIWSALGIVLVTIVGIIAFKQTPDWAAILGLLLIIIGVGVLNLFSKMSLH

SEQ ID NO: 661 - protein, 661 aa, Methanobrevibacter ruminantium
MKKFLSVALKFQWKTIVFIFALIIIQTFVQMEIIDLFGAALTGVKEQNVDLLFKSGLYMLMYTVISMIAVYVISFLTTRVASKSAYTVREKIFHILMNLPREEIDKFKISGLVTRSTRGMSSEQGFIVMILEQLMLIPVTFVAIVYEIALIDGTYALFFLGFIGVLSAIIIFRMKQIVEIFFRAKKTYGKLNLLFLSKINDIAGRIPFNKQEYEVEFEKACENSYDKNVIYIKSQCYLGPILMWGLYVIVLVTLAMVNSGYTIGFETDSVIDSFIILVYVAYFITTLANIPALIDRWPRAYATSVRLEEVLNIEDKIIKSNTNDNLKEIEIVEEDIAQEAKGIWDERKGISEKFTALLKEDKAKVRISMILLTISTLCMVYAPKVAGKTVDLLASNWNSTNDPAIYISLALLLVLYSVGYLFKLPPKRIMGATGEKVAYDLRVKLFDKLDAVGSDFIQENSKGLVLSRLNNDVMNIREFVSSKFTEIYAQILFIVFVIVLIVMTDFRLSLIYLVILPVYAVCFYVCDVKSKNYYDGHQMQLGRLMSYFERGLSNRDSFHEKGFKKMNQTVIDYYVKSKNVTNFMVPVTTLLTNISKITVYIAGIYFLAGNEIQIGTLLAVIMYGQLLTDPIKKLSSSMATIETSFSSIKRIFAIIDYKNDK

SEQ ID NO: 662 - protein, 275 aa, Methanobrevibacter ruminantium; identical to SEQ ID NO: 659

SEQ ID NO: 663 - protein, 110 aa, Methanobrevibacter ruminantium
MNLYKDIFYLAGFICHQKPERSFHISHCQLPFCARCCGIIISVIASFILAQFVAFPMNALAFLLFVPMIVDGLVQKYTDYESTNFRRFITGFLFGFAYVYVFYMFGLNAL

SEQ ID NO: 664 - protein, 286 aa, Methanobrevibacter ruminantium
MKILKTWIEKLDIILSILIVLDISFLTASFLLDLNTTYINFMLLFDTTLCWILIVSFIFKLLNSDDRKAYMRENYLDFLASIPMDLVLLPFSSLHISLINIVILVRFLRLLLLFKESYKYVKKFFKATSFDKVVALFIVIVVGSTFALEYFDPAIPNLYYSLWFVFQTITTVGFGDVIPESPVGQLIALGLLMVGVLMFSIFTASFAYLFNEKVFREENEDFHEKINTVRENLAENKERVEEIRQSTLSTSEEIAEVKEKLNKSEENIKNLEERIDYLIDMIEKKE

SEQ ID NO: 665 - protein, 383 aa, Methanobrevibacter ruminantium
MSYQENNASDKSLQDKDMKAKQRQDRIVKTSIIGIVVNLILVAFKATIGILVNSIAITLDAVNNLTDALSSIITIIGAKLAGRAPDKEHPYGYGRIEYFASVIIAAIVLWAGITALMESWPKIFNPDVTSYTTVSLVIVAVAVAVKFILGRYVKNVGEEINSQALVASGSDAFFDAILSFSTLIAALVSIFFHISLEGILGVIISIVIIKASIDMLKETVDSMIGERVDSKLSRDIKEAICEFPQVYGAYGLSLHNYGPDSMEGSVHIEVDDSLTALEIHNLTRLISMKIFNEFSIILTVGIYARNDDFKDIRNDLYEITSKYDEVIEIHGFLAYPEEKLITFDIIVDFDADREEVKDKILDEIKSLHPDFTYCMIDDYDLSD

SEQ ID NO: 666 - protein, 304 aa, Methanobrevibacter ruminantium
MNREERDRIGTRASAVAIIGNILLTVLNISVGLMSGSYALISEGAHTISDIATSVIAYVGFKIGSRPADKEHPLGHGRAEAISGLIIVVFLSIVAIEVIQGAFHKLFFGGALEVPDPIAVVMAFVGILVNLFMSSYIIRLGKKARSPAIVADGKHQRVDIFASLAIFIGIMVSQYGYPMLDPIIGIFIGALIARTAVIVAIDNLNNIMGKLPSDELIKEIRDVANSVTDVCSAHDIKVNYFGSYATVALHVELPPDMSLREAHKITHRVQDKILENVDMVQAVHVHPCPEGVQYDHSQLLDEDS

SEQ ID NO: 667 - protein, 67 aa, Methanobrevibacter ruminantium
MKETLIKEFKDLKEETGQASVELILLIGSILVITIICGTYVFNVNSKINGQFNQTMTKARLFLLNKV

SEQ ID NO: 668 - protein, 92 aa, Methanobrevibacter ruminantium
MSANEIEIFESGNGMNRLPRETVFEQIKRNFVQLKDETSGQGAAEYILLFGGVIVIALAGLLIYRSYFSNNTSGLNATQDINSIRDNMSNVL

SEQ ID NO: 669 - protein, 697 aa, Methanobrevibacter ruminantium
MSDSLDLFTGVLLTAIGLVLIYGSIIYRLIDLVLILGVLVTLFGLYKLLPAFFMRLLSSRKSSSRNKLSKANVSQDSLLKAGIEEINNFLDGEDNKENSKSVLRAPRESSLDAPNQMTFEEYMSKSKTDYATNYSPKEVKPIFKDRDVDESKQVLRTKPVKEEKSKFKLPSFKRNSSKKPKSRNFAFRKDKDTERSPDKLYFTPNYENPMMVSPKPKKKSENKLRLSDSPKRSKEISEALASVGTTETVYDNNASDDSYSYMPKEMDDELIVPIDEIDLDGPQEAPIYTLSQSENTLYNNVIYDDVDSDFYITPIHAESNEDNSPDEEGDYGEGGDLYLEVEPEDTSYGNDLYIETEPEDNYYGNDLYIETEPEDNYYDDEDIYIESYEEEQSYEDDDGYITVEASDDDLPIPRPKEISTPQSLPRPTSIASTNPISKKEVGSNLSRPHKKVSTLPRPSVSSNLQRPHKKAESTDAVSVKDESKAAEASIAKPKPIAKPKPVAKPKPKEAPKSDELISKEELDQIIQDPKDNTIQIDPNNPESLPIPKLLNSYVVCEKGILTSQEAFEEVASHSSQEILLEAPTIKDMGERFLSSIADIKTRIIVQEFDLADISYVLLLSSLIKKGVEIKTLPMVNSFNLIGDDSHALIISNSMDEDDFEYGAVYTDKPSIDNIKELFESSWSIANDLDIGNLNESE

SEQ ID NO: 670 - protein, 90 aa, Methanobrevibacter ruminantium
MDTTVKTVSIHLVAAVVAAIISTAFTLGWFGFKNNVFAFVIGVVILYFIGQYCKKAFGEEISGFSTWLWDGILPFGFFWFILWTILTNYL

SEQ ID NO: 671 - protein, 602 aa, Methanobrevibacter ruminantium
MSSVAGLSKYIRTLPKAKSTFLMIIVLSFIIGAVLFLVKPMSLGSGLENFFYGGAFGFVVYGLPAIITGATDQKWVSTLKGINLKMKHSMFLALVSMTMAGVISIIGTIIGNILHFDLFINSILFGIVIAFAFNILVIWSVTRIRLIKSVLVAIIQPLLMIGVLIITSFLNNLESVFELGIFTTFFKVIIASAVFLLAIYSFISIVESPMKKNLGFGALEILSFFISHMNEGSKSIEELFDNAGEAIDTLVGVCSFRKPDGDIKALFISPCVHPGPLGDIGGSNMPTILANRFDSFAMVAHGPSTHDFNPVSSDEIVKIESSVRTALENMEYSSKASRFVRYSHKKANIGTQFFNNGCVMLSTFAPSGSDDIEFAVGLATMIESQKELEIDNPILVDCHNSFNAEKGGVLPGNPELFQLLDTIKLIEKKDLEHEIKVGCYSTDLGGFGKHEGIGDSGLKTMVIEVDGQRTAYVLFDSNNMELGYRETIFNAVEDLEIDEIEVMTTDTHSVNTLSAGYNPVGTVEKEKIIEYVRESIIEAIDDLETVEAGTRTERIENLKTFGPNNSTELISTISSIVSVSKIAAPLIFIMAIIFVFIWIYLF

SEQ ID NO: 672 - protein, 334 aa, Methanobrevibacter ruminantium
MKAGVLVFTGSLVAIDPSFYPIMLLQLVIGAIMILYLDEVVSKWGFGSGVGLFIAAGVAETIIVGTFNFLPASAASTTASGILPAFIQSIIGGAPNFQILIPLIATIVVFLIAVYGESMRIEIPISHGRVKGHGRIRGAVGKYPLKFIYASNMPVILTSALLVNVSLIASLFQKLGFPIFGEVSGGRAISGLALWLTTPNSISVLFTNPLRVLFYAIVFLGCCVLFSWLWVEISGSLSAKEVAKQLYNSGIQIPGFRSSKRQLYTIMKKYIPALTILGGLFVGILAFIADLTGALGGGTGVLLTVGIVYKLYEEIAQEQLMEMHPMLRKFLGND

SEQ ID NO: 673 - protein, 202 aa, Methanobrevibacter ruminantium
MAYQGSFLLGISWLQPVFDAMNAVLNPLVQLDPTPNNPVLTVFVISALISLLTVTAQKLLVDQDKMNEMQANSKALQKELREAQKSGDAKQIAKVQAKQTDMMQDQSEVMKMSFRPMIVTMVPILLIFDWMWQSAIRSLIVVFPPAVYYCTLTPIFHSLGQMLYGGNITTIPFGVGWLWWYFICTFGMSQIIRKFMGFKNGF

SEQ ID NO: 674 - protein, 159 aa, Methanobrevibacter ruminantium
MAFLIITCLFLIFFFGSGKVIYQTGFFGIVVTDDSWHYGLYTFFRVLGCFPILGFLALTTPIAKIFHCLETLKVPKIVIEIGLLMYNTIFIFLNEIDVMQKAQKTRLGYNSYWNSLQCLGSLVSNIFLRSLEKSETLQNSLDSRGYDGELPVYIPPKEE

SEQ ID NO: 675 - protein, 95 aa, Methanobrevibacter ruminantium
MERTTLIILAVICAIIFIAPLVMYSGLGEDDGYFGGADDAAGEAIEESGFKPWFSSIWEPPSGEIESLLFALQAAIGAIIIGYFFGYWRGQGKEE

SEQ ID NO: 676 - protein, 221 aa, Methanobrevibacter ruminantium
MHIMEGYLPLTWCIIWFVVSFIVVAYGIYQIKQIVDETPDSKALLAVSGAFMFILSSLKLPSVTGSCSHPCGNGLGAALFGPAVTAVLATIVLLFQAILLAHGGLTTLGANIFSMGIIGPFVAWLVYKACIKANISSTIAIFFAAFLGDLLTYVATSFQLAFAFPAPSFGSALTKFLVIFAVTQVPLAIGEGILTVIIWDRLKAYKPKLLDKLGVLAPNEA

SEQ ID NO: 677 - protein, 112 aa, Methanobrevibacter ruminantium
MSVFDYICHRRPERSFFYKGRQFPVCARCTGFYISGIASIILFKYFPLPNTLTTLAIGILLLIPCAIDGTSQLFEMRESNNVLRLITGLLGGVGLIMIYEVVLNFVFLNFIY

SEQ ID NO: 678 - protein, 117 aa, Methanobrevibacter ruminantium
MSKFCPKCGCENLDEASFCLECGASLPSIEEVKERSSHGAGTSHQSTFSSNLNEENGFNQETSSFSQSNSNSNEASNSSKFKNVINEANPANNDNQDYAICCLVIFVLLLIAFLCNF

SEQ ID NO: 679 - protein, 219 aa, Methanobrevibacter ruminantium
MIPYYILPSPLNVFNAAWTLITNGKLFMHTSSTLIKVFSGIILASVVAIPLGIILGWYETLDRLSSLIISILRPIPPISWIPFSILWFGIGLSSAVFVIFIGCVFSVLVYTIDGVKRTDNVLIEAAQTLGANNWDILLKIVLPSTLPYIVSGLKVGVSIALMCTVSAEMIASSRGLGYMILTASQLFQPGTVVVGMIVIGIIGILFDYGFRKAQERIFW

SEQ ID NO: 680 - protein, 341 aa, Methanobrevibacter ruminantium; identical to SEQ ID NO: 331

SEQ ID NO: 681 - protein, 154 aa, Methanobrevibacter ruminantium
MDSKGLINIELLFCTIIIVMILIVNFPILEHSIDSANDMDENSQGRFLLNSISTSIDQVNSNNEGFSKKIKLPQSVDGNYYTILVSSNEIILEFNNKKGKAKIQPINLVDSKNRTLSKAQLYNGGSYIIKKTLTNNNESHIYNQSSIIIMQVEG

SEQ ID NO: 682 - protein, 418 aa, Methanobrevibacter ruminantium
MNKYIKKWTESSLILKIIGGLIIGSVLGILVPQYKLIGLPGELFVTALKAIAPILVFILVASALSRASEGIGSRFKTVIVLYLFSTFLSAMVAVTGSYLFPVGMHLTDASDVAAPGGLGEVISSMLLKIFANPLQSLSQGDYLGILFWAIVIGLCLKKIASDSTLDVFSDLADATSLAVRGIIQFAPIGIMGLVFSAVSESGLSIFIQYGQLVLLLVGCIATVAFVTDPIIAAFALRRNPYPLVLTCLKESGITAFFTRSSAANIPVNMRLCERLGLDKDFYSISIPLGSTINMEGAAVTITVMTLAVCHTLGISVDLPTTIVLCIISTLAACGSSGVAGGSLLLIPMACSLFGIPSDISMQAIAVGFIIGVVQDSCETALNSSGDALFSATAEYHDRVKRGEDMNFLGEFAKDKAKQ

SEQ ID NO: 683 - protein, 697 aa, Methanobrevibacter ruminantium
MIKKVTNVIDEITDFLFGLKMTIISGIFLLIAVIFMIFGIDTPIYLNPAWGTVIISGIPMLLLAMTRLIREKWVSSALLIAIAMVASLLIGEIFAAGEVAWIMALGALLEDWTVERAKKGLRNLINLTPQTGRRIVGDSEEVISVDEIRIGDVLRILPGESVPVDGEIIKGSSSLDQSIMTGESLPIDKEVGDEVFCGTMNMYGAIDIKATSLGENSSLQKLIDLVKAADEKQAPTQRIADKWATWLVPVALAIAIVAWLVTGNIERGVTVLVVFCPCALILATPTAIMAAIGQATKYGVLIKSGEALETLGALNTLVFDKTGTLTYGNLAVSDIISLKDDLDEMDVLRIVASCEKLSEHPLAKAIVNYANEAKVDIEEPEDFKMYPGKGVYCKNSYGHICAGNSKFLNENNIDFNIGSKDDLDVDSILNHLKQEGKASIIVALNGEIIALIGLSDVMREDSKAMIESLHDLGTETVLLTGDNTETANYFASRLGIGKVYGNLLPQEKLDWIERFKDEGKKVCMIGDGVNDAPALKTADVSVAMGSVGSDVAIEAADIALLGDDIGKIPYLKKLSNSTLFTIKANIIISMTINAVAIVCSVLGLLNPVTGAIVHNAGSCLVVLNAALLYDRKFDDSIKRIDTENVEHSHYHFHNDGEHSHSHEGIRIIDEIKTDNGIKHMHIHKHALNRQSCEAYHN

SEQ ID NO: 684 - protein, 286 aa, Methanobrevibacter ruminantium
MDESANKMNKFDVLGSMNLRTKTLLAIGLSAFILIVVVLVSFFIDPTSITTDWSIMNQPPSLEHLFGTDWMGRDMFTRTIKGLGLSVQIGFFASILSSIIAVALAFLSSFNKYLDSFVSWLIDVFLSIPHILLIILISIALGGGAFGVLVGVAFTHWTSLARVLRAEIKRIKTSEFVTISERLGKSKFWIARKQILPLVISQVIVGTILIFPHAIMHEASVTFLGFGLSPHEPAIGIILSESMKYLATGNWWLALFPGLALLILVLLFDIAGENIKKMLDPASAND

SEQ ID NO: 685 - protein, 77 aa, Methanobrevibacter ruminantium
MQFLSFSELFGGTVLVEQVFMYPGIGQAAVSAGLRSDVPLLLGIVIFSAIFVYCGNLIADILYNFVDPRIREGEENG

SEQ ID NO: 686 - protein, 207 aa, Methanobrevibacter ruminantium
MSPINPVNAYISNMVVSPEKIAKLEAYWGVNQPITEKLINWLGNIITGDFGTSLIYRTPVLQVIAEKFTASLILMLTSWVISGILGFALGVLAGFKRDTWIDRVVKVYCYVLQSAPTFWIALLVVMVFSIYLGWFPVSGGVPIGALSQDVSFFDWLKHLILPAFTLSILGVASIALYTRDKLIEVMTTRIYFLLLPKAKRGIRMDLD

SEQ ID NO: 687 - protein, 602 aa, Methanobrevibacter ruminantium
MKNIRQTLSTIGKMLSPLKKSIPSIFLIFIFLLIDVYCNLTLPSYTADIVDVGIQNTDFNYIISVGTMMMTMVLIGVLATIALSYFSSKVSAAYGRDLREISYEKILKFSNFELNKISRSSLITRNTNDVYQIQIFLGLLFTTILFAPILGIGSIIKAMELGTDLLWIIVVTFASVAILLGIIFIRTVPYFKVMQELIDKINQTSREILMGMPVIKAFIRQDYEEERFEKTNEEFKEVNLHVFKTLFLMIPAMTMILNVMIVLILYFGAYDAINGKILTGTIIAFIQYSTQIVISFLMLGGFTIMIPRILVSGRRVGEVLNTEISISDGPIDKIDENPTIEFKNVGYSYPGSEKETLKDISFKLEKGKTTAIIGGTGSGKSTILNLIPRLQDVTEGQILVNDKNIKEYKLSTLRERISYTPQKAILFQGTVRSNMQVGKEDATDEEIEKALNIAQVDFIESLDDEVTQGASNFSGGQKQRLSIARSIMDKRDFYLFDDCFSALDMNTEAKVKENLKDLKESSSILIISQRISTIMDADEIIVLDEGKIIDKGGHDYLYKNCDIYKEIVSSQIERSEDLIYDNEETASFTIDSSSIKKAAGGK

SEQ ID NO: 688 - protein, 595 aa, Methanobrevibacter ruminantium
MAPRPRRLPPEKPTNVKEAIKNIFGLLMGYKLKLSITVICGILSTVFSVISPLLIGLATTAIFDGINSGNMNLEYIINLLITVVILYIISAVFSYLQSYFLLEITTDISYNLRKELIEKITHLSMGEMDKNTRGDILSRITNDVDSLQTGLNQTFNQLLSGVITIVGVTIMMLSINIWLTLATIVLIPIAFLIITFVTKHSQDYYTKQLTYRGSLNGQIEESFTGHEIIRSYNQEEQSMETFREDNENWYEQEWKSKFYSSLSAPLMNFISNFQYVIIAVLGAVFVLQNAIAVGDILAFIQYSKNFTTPIQQITRVMNMVQTAMAASERIFGFLEIENEENPSKEKIEKINDSITFENVTFGYTKDEPVIKNLTFTAKKGEKIAIVGETGAGKTTIVKLLMRFYDVDDGEIKIDGVNINSYDKHSVRSLVGMVLQDTWLFNDTIYNNIKYGKLDATEEEIISASKEAHADHFIRQIPEGYQSELNEDVDNISHGQKQLLTIARTIISNKQILILDEATSSVDTRTEKIIQKAMDKLMEKRTSFVIAHRLSTVRDADKIIVIEDGRIIEQGSHEELLEQKGYYYNTLNTQRRENIV

SEQ ID NO: 689 - protein, 345 aa, Methanobrevibacter ruminantium
MIFVINLVPLSLSVVTFLSLFLSGGFTILFGADLAFLVLSFGQHEFTHPFGPIALLAIVTALASLKVMEGSGVDISRLKNIVYVFLIAITVFGGAMHRSFLLLWFIGLFIGYTIISKSFRQKSILTIRRILMFFLAALVAFGLLELVSRILSMEVFSPLLRISRLAQNSLASLKLVIGNTQLIGHDPASSYWSDSTGFADGYISLPMQFILMFGLPFPLFFGLLVTKKDTIDYMLPGIFGYAYDFGYLTFVILLLLVLFTIIIGLLVLREYRLKREKNNKKYLGKEVLLIGSLTGFIAQAIIGLFLFNRTINGMALLTFLFLGSLVLAHVVTIRRDSNEVLSQQI

SEQ ID NO: 690 - protein, 724 aa, Methanobrevibacter ruminantium
MEEKKIESTDVEVNESKDLNLDSTVENNEIDKTEELDASSEIDENEELGTSSEVRETIVIDTASEVVEADVVSETIDSSESVKDEEEDSNPLDVEYVEEDGKRRIKPMLDYESLSNTSEIEVPPLLIDQVIGHEESVETIKKAAKQRRNVLLIGDPGVGKSMLAKGMAELLPPEVLEDVLVYPNGEDSNYPLIRTVPAGQGKKIVKANKANAKSGDEKKMMITMFATAAIFVLGILYQRIFEAIIAALLVIFISMQIKPKANNMSPKLLVNNGDKRFAPFMDATGAHAGALLGDVRHDPYQSGGLGTPAHERVESGMIHKAHKGVLYIDEIGTMSMKTQQELLSAMQEKKYAITGQSENSSGAMVRSQAVPCDFVLVASGNIQVLEGMHIAMRSRIRGYGYGVFMKDYMEDTEENRKKLVQFVAQEVKNDGRIPHFATDALDEIILEAKRRAGRKNALTLRLRELGGLVRSSGDVAIEEGADLVTAEHVVTAKRFARTLEQQIVDRSIIQRKEYSVFHSSGGKIGMVNGLAVMGDRSGIVMPIAAEMAPANSKNEGKIIVTGKLGEIALDSVQNVSAIIKKYTQVDISNHDIHVQFLQSYDGVEGDSASVSITAAVISAVEGIPIDQSIALTGSLSVRGDVMPIGGATAKIEAAAEAGIKKVLLPKSNMEDVMLEKKYEDMIEIVPIETIEDVLENILINGSKKEKLINKNERNQWSSHKQGLY

SEQ ID NO: 691 - protein, 88 aa, Methanobrevibacter ruminantium
MSSGLTIGLLSLIIFGNIENLILASQGVVKAANPLKLAIFSLICVSCWLILGTVCTQQLQNYGIYIEFIGGFAIFVLGLQSMIEAARG

SEQ ID NO: 692 - protein, 95 aa, Methanobrevibacter ruminantium
MSFAESLKEYKPFLGLLIFGNIENLVLAAQGVIEGADPFLVAGASVCFVIIWQFIGVFGTKSAMKYSRHIEFIGGFAIFVLGIQSMLPLIYQLLG

SEQ ID NO: 693 - protein, 139 aa, Methanobrevibacter ruminantium
MYLTKFCPKCGEENEDVAQFCSNYGHDFKDVNQRMKESKRENSSFPLSGTKILLCIVLLIVLIIAAFLFTGGNADKPQNITMIKENTYGFTFVNRGVLFYNYHLDEVLPICRMISRAMTLRQDSTMQMTHWLRSIMITI

SEQ ID NO: 694 - protein, 258 aa, Methanobrevibacter ruminantium
MKSIEDNASEKTKQKLQKKQKKIDDISEADIDEQIETLEKENKKLKRYQRILDALQEKMEIDSGRVMGLTDGIFSIVMTLLIFGITLPSTEILTDAGLSSFISSILPNIGVTLVSFILLASFWIYHHEFIKLKCLNLVYLWLSMFYLATVCFIPFTTTLIGTYPEFRLSTNIFGINILLVIIFFLLMLNYASKRGFLDEEVIEKDKKYVHHTLYIILGLAVIINLLDFSVNENFIYLFFLVPIISTIRDVRFKLKNTE

SEQ ID NO: 695 - protein, 553 aa, Methanobrevibacter ruminantium
MQEKIDLVSLPKKSFWKLSIPIIAFCIFDAIYGIVDMLWVSRISVEAFYAIGVSIPITSLIFSFGDSIGQGTNSMMSRFIGTGDYESAYNTLIHGILIANIIWLILVLCLIFAQGILFKVDDADSYILIFDYMVPMIIFAYVFILNNLFSETFQAEGNSHTPTILIIGSNILNIILDPIFIFDLNLGIKGAAYASVLSSLITFSVLMFLYTHGRTKIPLSRKYFKFRSYILVEIFKVTFPNFLDDAIWSFTMSFINVILIGTMGEIGPILYSVSNKIRSLLNAPTKGYGRGLMSVTGHLFGAEQFDKLKEMYKYVLKIAVCTSLVIMIVFFFVRNWAFGLFSITGMDNEIFWIAVGGIIMMTILPFSTISSKMLDGFGKSLYSLLITIIKVAIEIALISLLTQYLKDGSSVLIGIILSEIISSIVYYKFLGYLFDHFDKKYEFKYTVKAFTIKRKDKREKRRERIRQNIEEKKLRKEEKKEEFRQNIEEKKLRKEEKKEEFRQNIEEKKMRKEEKKEEFRQNIEEKKARKEEKKEEFRQGLEERKEKRKEKID

SEQ ID NO: 696 - protein, 825 aa, Methanobrevibacter ruminantium
MINRLRKDFGRIIKLIIFLILEVILFFAITQTFGGIIIPDLKTAFAIIIALSILNALLWPTITYLSLRFIVLTLGFGTFLIDGVLLYIISLFIPGVSINGIALFSIPLLIGLISSMLSIILNIDDDYTYYRYILEKEMKVIHRNIPKKEGFLFLEIDGLSYRIIKEALDNGDMPTLKSWIDKGSHRLISWETDLSSQTSSSQAGILHGNNNNIPAFRWVEKDHENRIISSNGRTDSKLIEKRISNGKGLLSLNGASRSNLFSGDAKDHLLTFSRFSDSESINSNSWFYLYSTPYVIARILVLFIFDMIMELLSRVRHLFKNIQPRLKWRGLKYFVARAGTNVVLREATTFTLIGDVFAGEHNVIYATYMGYDEIAHHSGIEDFDSFYSLRQIDKQFKHIENAINNSNRDYKIIVLSDHGQSNGPSFKQKFDISLNDLLSEFLPENITVHSILHSNDDHFSKEFSINHLGSENLEKLDKRVENTKEKLDIKIDNTKEKLDHRIDNTKEKLDHRIDNTKEKLDHRIDNTKEKIDTTKEKLDHRIDNTKEKIDTTKEKLDHRIDNTKERIDSNLDYTKEKINTSFDGELINTWDKLIKFKNKSSNKAFLDKLRKKRTLINNDEPIIDRINNVSEDLSEDLEVNIELSKEKITSDKAAQTIVLSSGNLGLIYFTDWSNRMSYEQIEDAFPGLINQLASHDGIGFVMVKSDIYGTLVFSNDNLFYLESEEYVGENFLDKFGKNTVQKLKRTDKFAHVPDILVNSEYNMETNEVYAFEELIGSHGGIGGTQQYPFILCPSNWESEEIFGAENVYKFFMKEINKSWNQSKNK

SEQ ID NO: 697 - protein, 94 aa, Methanobrevibacter ruminantium
MSQARNLEKDVSSSKAYFKGENELSINSNINETKFNEMTDSDSNFFGTRFILNLSLILKLILKKQMKVISQIEIISNNQKTSKQFQYKIIQKTL

SEQ ID NO: 698 - protein, 296 aa, Methanobrevibacter ruminantium
MKKIYLIFPILAGIMFGSTGIFVRTLTENGIDSTTLLFLRFSIAIIYMLIAIVLTDKSLIKVSKEDIPLFLICGLCILGLNLCYNNSINTVPLSLAAVLLSTAPVFVVIFAYFIFNEKISSAKVISIILVIIGCILTTGLLEESMIPITSIGLISGIGSAIFWAIYTIASRKSIDRGKHTFTILFYSLIIITIVTIPFTNFGQIESFVLANPANNIIFLLLHSLISFALPYILITISLNHLDAGTVVILSSGEPVAALVFGAIVYNEIPSPLMFCGIIITIIALISLSRKIEMKSE

SEQ ID NO: 699 - protein, 118 aa, Methanobrevibacter ruminantium
MHLLWFYVAIVLAISDEIHSRIVWGYVRDFYIVFGGIISSSLDSVMETWIVHEGLEALFHMIFVSIVFFSLKIGFLAALIHFLLDVSHSIVIRHMPWLPHRALHFVIECLFFIAVFGL

SEQ ID NO: 700 - protein, 352 aa, Methanobrevibacter ruminantium
MKHRLNLDNKDPNYILLKEIIKIMDSRKSKSILASYGFKNLNRTIFTFKIIFISMFLGIDISFILNELKSKKELRKYFNISEVLTADQVYKIFSEINSEKLIKCLNRILNLRNMVKRRGKKTFIVDATPVDVDINFHRNKKTKEHLEKINLKWSYSSSKGYYIGFKATVVLDYDSMNPVCILVHSGAPNDAKLFEEILENLQKRRIIRKGDTLIFDKGYYTYKNYQIGISKYKIIPFIFPKEKFSRTRLDDILTYPLAVFNKTKRIMKEKRLYNSLKMELMKKIDSWEKFKPIRGKIEDFFKLLKQGLNMREIHKYTPKSVEKTVYLNVFLGALIISQGFYSKTTIQQLSEN

SEQ ID NO: 701 - protein, 44 aa, Methanobrevibacter ruminantium
MTTVVYTVSNAVLLMLFYSWYNLYEKGVISEERFGRKRNYYNSF

SEQ ID NO: 702 - protein, 282 aa, Methanobrevibacter ruminantium
MRKERIKSYLGIIFDLLVILDLILIFISLPIQGLHLIDYAGFVRAFDLTICFLLLIEFFYGLYKSDAKAKYFKEHFLDLIASIPFDLIVFALFGSSSIILNLARFLRLVRVVRVFRAVNIVKKYGLEKVIRRTHADKIFIVIAVIVVIFTILLTLSGHENISDSFYFVVITLTTVGYGNEGFNEPLAKFVTLFLIIVGVLVFSTITGVTSSFFIDKMLEEGISVDENLHFINQKLNFHEREMEKTRKELAEIKKELEKSNENSEELKQEISELKELIKENNK

SEQ ID NO: 703 - DNA, 702 bp, Methanobrevibacter ruminantium
ttggaccaagtcattgcatgtcttggtgcagtttgtgcaattctttggggagttcttgctattcgtagtgtagcaagttacggtttaggtactggtgtaccttctattggttacatgtctttaggtataggtgtaatcggtgcattagcaggtgtaggtataattgcagcatttaaattaaaaggattagaaatgctcggaccaatacttgcattagtatttgcaatgctcattggtttattagttgcaattgttgctaagaagattgttggaatgaaaatccctgttatggaaagatgcacagctgaaatcgctggtgctgctgctttagctgttctcggattctcctctgcaattgcaggtggatactctattgatttattattaaccgctgttgtagctcctggattcattgctctcttttacatattagttactatggctatccaacacccattcaacgcatgtttaggacctaacgaagatcaagttagaactcttaaatgtggtgcatccactgcattcttaaccatgattattactggtattctcgcaatttccgctggaggatacgcatggtttgcaattttagttgttggacttatcggctggtacgtctcatttaaaatgtttgttaatgcttcctacgaagctgcagcatctgttaaatggtccggattatggccaaaagttgaggaataa

SEQ ID NO: 704 - DNA, 702 bp, Methanobrevibacter ruminantium
atggatcttttaatatttattatatgtgttgtaatcgcaggtattattatgggtggaggtgtacacttcattcctgtaggtggtgctcctgcagctatggctaccgctaccggtgtaggaactggtaccgcaatgttagcagctggtgcaggattaactggactaattaccgcagcttctatgaccggtcaaccagtatggttaatcgtattagcaggtgcagttggttccatgttaatgatgggtatcaccatgcttattggtaactttatttatattttcggtgttggtgtagtaccagcatctggtaaagcagcagtcgacccaattactggttggaaccaagaaaaatacaaaaccccaggtaccgaaggacacggtattcctaccgtctgttacataagtggtatcatcggtggtttacttggtggtgctggtggaggattagtctactgggcaattaatgaatttgctactgcaaacttaactggatttgacgctactgttatcgctggtttagcagctattctctctgtaggtatgttctttatcaattcagtaactgcttcctataacattggaggtactattgaaggtttcgtagaccctaaattcaaaagactcccaactggaatcctcgcttgtgctgttgtttctcttgtagctgctattttcatggttttaatgataggaggtatttaa

SEQ ID NO: 705 - DNA, 873 bp, Methanobrevibacter ruminantium
atggaccctattacattaggtgtagtcgcattgatgggtgcagcagcaaccattgcaggtgctgcagaggacttagaatctgacatcggttcacaaagtaaccctaactctcaggttcagctcgctccacaaatgggacacttacaccgtatgataaataaggcagcttctggggaaccagtagcatacggatgctggtgtggtatttccggtgctattgcagctcttgctatgggtatgggtattatacctatagtggcaattgcaatgggttctactgtcgctgcacttgttcacgcaatttatacagtcacatcacacatgggaaggattgtcggtcaatctcaatttgaacaaccattatttatggacgtattaacccaatccttaggccctatcgcagctcatggttttatagctagtttcggtattgtaggaatcgcttatttaatgactcttccattagacggacttggacacccattcccattaccattactcgctgtactttggggaattactattggtgcaatcggatcatccacaggggatgttcattatggtgcagaaagtgaataccaaaaattcgactacggtggaggtactcctgtagcgattcaaggggatatcgtaactaaagctcctctcggtgctaaaaactctatcgatgtaggtaacttctgtgctaaatatggtggacctttaaccggattctgttttggacttattgttttcgtaagcttctggattactgttgtattcggagctttaggaggacaaattgtaggtattgtcatcgttattttattaatcgctgctaattacttacttgaaaagtctacaagagcaaaattcggaccatatgaggaataa

SEQ ID NO: 706 - DNA, 5628 bp, Methanobrevibacter ruminantium
atgaaatataataaaaagatattctttttatttttattattgtgtctcataattcctcaagctatttatgcaggggatgttgatgatttatcggatgctggtaattacactagagataattcacctttaacaataagttccacttatcaaagttctacttatggatccgatgggggatatgatgataaaaatgagaatatttatattttagataaagttagtgatggggataaatctaaaacatgctgttctaaggacctttctttagataatgcttgttctatggataaatcttcttgttctaagagcaattcagcttgttctaagggcatatcttcagataaagattcatctaacttgtctaatacatatttagtttctgaaaataattataatgattttaatgttgatatagatttaaatgataaactttcagatttggatttaaacaatgatttaagtcttaataaagatttaactcttaatttaaattcaaataacgatatggattatttaaatcttgaggaagttattcagacagatggaactttaacttatgagggcgatttggatcaaacttatttaaacgatgagtctttaaatcaagatgttcaaaatgatgattctttaaataaaaacgatttaaaatccccattaagtgatgaaaacacatttaatatttttataattagtgataatacaggaaataatctttttgatgcagtggcatgtgaaatcttagacaattccaatttttctaatgtcaaattcaatataagaagcggaaaccaaataaatgcaatgagcgaggatgaaatctatgaactgatggctccttgcgatgcattcatcggccagtgggtaagctccaatgtggatgcagtattaaccagtcttttaaacaatcatcctgaattgtcaaataagaaactgttccttatcttggaaccacctactggaaacatcaattcaagctccagttcattgaatttggttagaaactctacaattgactataagaagatattcaatggaatttccaatgacgatttgataaattatttcaaggctaccaaaagaggaaacaacttcgaaagcattcaagaatacattgacaatgaaggaagctcttttaatagcatctttaataatttggttctctataaggatataaacgataaggcaaatcttaaaaacgaattgctctatatcctttatctattgggacatggatgttcctatgagtctgcaaactttacaggagtacaggcatctggaatattccgtgacaggtggtattcatttgatgaatacgttctcaccttcttcaatgagtccagaaatcgtaccatagggattttggaaagtacaatgtatatccaatcccaacaattggatttggtaaatgaaatcacagaacgccttgaatcaaaaggatataatgtcattcctatttactgtccggcaggtaacgccgaacagctaaatatcatggtgaaatattggaccagtgcctgttcaaacatcagcggattcttagagaatccacaagactttgacatttatgtggatggaattatttccatggttgcatatggtgtcggtggagagaacttcaccaatgccacaaaattctttgaagatgcaaatgtgcctatattcagagcggttcactctgaatacattaccaatgagcaatgggaattaagccctgtaggtctctctaccactaaaagtgataaatggtggcacgttacaattgcagagtcccagggaatttttgatgctacatatgttggtggtgttgactcttatatttcaaataggacaggagcaatcatattgacttttgttccagttcatgagaatatagaactcttgactgatagggtagacgcttgggtggacttgaagtatactccaaatgaggataagaacatatccatcgtatactacaactaccctcctggtaagcagaatatcggtgcaagctacttggatgcaatcacaagtgtctataatatgctttataccttaaaggatgaaggatactatcttacagacttgccaaacaatgtttcagaacttgaagatatgatgattgcctgcggtataaacgtagctaactgggctcctggagaagtcgaaaagttagctaaccgttcaggtgtcgctcttcttcctgtagatgaatacttggaatggtttgattccttagacgatattgttaaagtccagattaccgaaggtcctgttgcctatattggccagatggttaggcgtgcggttctaatcaactacaccgatgaggtggagacaatggtcaatgattggtacaatcaaatcaaggcattgcttcctgaaaatcagactgttgctgcaacaaatatattggataagcttgtaaacagcctgaagctctatgcaaacgcatcttccgatggcgatgaaaatgcatccctttactatgatgaattcttaagatattatgatgagtttaaaagtttgaatgtttctggattaaacggatggggtgaagctcctggaaatatcatgctggttaatcggaatggaaccgattactttgtaattccaggtcttacattcggtaatgtcttcattggccctgaacctcaaagaggttgggaggctgacattgaaaacctttaccactgtacagctgtagctcctactcaccaatatttggctgcttactattatatgcagaccaggcaatcaaatgccatggtatttgtcggaaggcacgcaacccacgaatggttgccaggcaaggaagttttattatcatataatgattatggttctattgttgtcggaaaggttcctcaagtatatttctatattactgatggtttagcagaggctatacaagctaaaagaagaggatttgcagtattgatttcccacttggattctcctaaatcatatactcatttatatggtaatctaactgtattggcaactctattggaggagtatgataataatcatatcattatagagtctgattctgataaagataatcaggctatcacttatcaggtaatcaaggataatcagactatcacttatcaagtaatcaatcaagagttagaggacaatctaacaagagcaatcaaggacttggtaattgcaaacaattactaccttacaattggattcactgcagaggaattgaacaatactgacatgttctccctaagctcaactttaaatgctttcttaaagaacactcaaaataccctatatccattaggacttcatgcaataggtcagaaatggacagatgaggatttggcgaacaccgttgcaatcatagtctctcatgactttgaatatggcggcaagaagaccaatctattcgatcagctatccttgtattactatggggaaaaatattccaatctgactccattgaagcgtgattatatcctaaacaggtcagtggatgtctgtaaggctttaatctattgggacacagagacagtgtctgatacaattggtataggaagtccagagttcattgagtcattaaacattgcaaagaaatacattgacctttacaatcaatgtatcagccttgagctggaagagatggtttccgccttaaatggaggatatgttccagtcaatataggcggggaaagtgtgactgtccctcaagtgctccctacaggagcaaacatgtaccaagaccagtcatctgagcttccgactcaaaaggcttgggattatgctaagacactctcacttctaaccttggcagaccttaatgacactacagaaaagataatcatgggtatctggtgtgtagagactgcaagggatgacggtgccctagtctctacagtgctctaccttttaggaatggagcctgtctggcataactcatcaagtgcaggatttgacgaagagggcattcctacaggtaagaaagttgaggacttgcctaatgtcatagcattggaaaacctcacccgtcctgacggatgggctaaaaagagaatagacgttactgtgattaccagcggattgttccgtgatctatacagttcacaggcacgtcttatggacaatgcatacaggatggctttagcttgttcatattacactatcgtaaacaataagacaattatggatagcgaatatgggcctcaagtctatgatgcacttagatccatcatgagaagcattagcttcaagggaatgtcaaacgaatcattagaagacaattatgtcgctaagcattggctagaggattgcatctattatctaagcctaggctataactctacagtctctggagaatatgcaataacccgtatctttgcacctcctaacggggattatggtgctggaatatcaaagcttgtgtcaatgtcatggacctggaacgatacagatgagctttcagagttctatattggcagaatgggaaacatgtattcaaaatattactggggagatacaaaccctgtcgtattcatgagggcgctatccgatacagaccatattgtggtaagccgtaataccaaccaatacggagtattggataacgatgacttctttgattactggggaggtctctcaatgacagttgaatacctatccaacaagactcctacaatgaatgtattgatgtatgcaaataaggacaatgcatatgttgcaacattcgagaatgttttctataacgagcttaatacaaggtatctaaaccctgaatggatcaagggaatgatgcaggaaggctacagcggttccagatatatgtccaacaagttcatttccaacctatggggatggcaggtaaccagaccttcatctgtctctgaaacagtttgggatgacgtttacaatacctattataaggacaaatacggattaggagtaaaatcatggctccaatctggaaacaatgcatattcattgatatccatgagcggaacaatgttgaattccgcatattcaggatattgggatgcagatgatgctacattaagtgatatagctaacacttgggcacaggctacagttgcaaatggggtagcatgctgtgactgcagctgcggaaatgtggcaatgatgcaatgggcattcaagtatgtgaatgctgatttgcttgctaagttgatgcctaagttgtatgacgcaactcaaaatccgctcttctatacaaatagcagtgatatgcctacaaactcttcgaatattgaccgccgaactacaaacagcagtgcagagtcaaacaatactgaaactgttcagactaactcaagctctaacagtcagcaaagcgctaacggaaacactaatattccaggagcaagcggcggctatatggtaggtacagaagcggatgcccaatcagatatggccagtgattcagatgcaggaatgaacgatgcaaatggagaaggcagatctgtagaggtcactaagagcacaagcactccagtggctccaaaggacgtaagtatgcctatagctattattgtttgtgttatttgtttagtggcattaataggattcggttatttcagaaacagaaaagacgacgatgattattataatgatgatgacgatgatgattatgaatataaatag

SEQ ID NO: 707 - DNA, 5364 bp, Methanobrevibacter ruminantium
atgtcttttggagctgtctcagcagctgacctaaatacagtccagtccggtgaggtttcaggtggagttgacatagccagctcaaatcctggagtcgaaaatggagaattgacttacgaaattccagatagtgttgaaaacattcagtatgcagggctctttgttgacagctatactgcaggatcctctaatttggtatatggatccgaagcaaatatcactttgacaaaaaacggcgaaagcgaacagatagcaagtgaaagacttgttgcaagtgtgggaagtgcagacggtgaggtatatgtcattaacgaccacacaacaaaatgctttgcagactatatgatgacctataaccttacagacagacttcaggatgcaaagggaaatatcacaatcactgtaaatgccactcctatcgaaggatacacattctataataaaatcaagctgataggccttgtatttacatatgatgatggagatggagaccaattccattattgggtaaatgcaggttcatcttgggtaaagacagatagcggagagacaagcaaggctacatttaagcttggaaacgtgaattacgacccaactgtagccacccttgataactttgccctttcaagccaggatggtgtctataccttcaatggcaaggagatggatgagtccatagtcactgaaacaggggtatactattatatccatcacaagtttgacatattggataagattaagaacatgacaaacacccttgtatacactccaggggaaggctcatactcatttagaaatgttctttcagtggtaaagctggtaaagacagttccagtctatgctaaagtcaacataagctctgaatatgatgacattgtcttttcaggaacagaaaatctgcttaaggtgggcataaccaataatggtacaggctctgcatcctatctcttggatttatatgccgatgggaaaaaggtaaacagttctcaaatctcattagctgcaggaagggaagctgtaatatccttgattgacaatacaattaggccatctgcagcagacactgtaagcggtgcagataataagaagatcaattacactgtagttgttagcgataagaacactggagaggttttagatgaatccagcatcttccctaatctcctctataacggttatttaggcaagggcttggcttatcctgcagaaaagataagttcatttaagaatatcacagttaatggaggcatgatcattgagagtctaggtgattccacttatcttgatgcttcaatgactggcaaaaccgattcttggactattgatctgcctgatggcgctttcttcactgatgcatttgtctatgtgccatataatcttgataatggaaatgttcctatgttcacaagcacattcaatggggcggcagttaatcctatagcttcatatagggatcagccaaatataggagaaaatgctaaaaacggatacggattgcttgtttatgatgttggagagctcattaaggcaggtgtaaatagctttgccttatcaaaggaagcaggtattgctggagtttatccaagcaccctaattgcattttacaatctaacagattcagaccttctaacaagcgcattcatattcaatggggcagacctattatccaatgaatacaattcacttggaagagatgtttcaagcgataatatattatccatcggcgcttttgatggattggtaagtgctaagcttcatgtatttgctgccgattgccaagctggagagggagacttgactgttaatggcaaaagctataagaatgtatgggccggtacaaatagaagtgtcggcgattatgtggttgatttaggaaaatccactaatgcatcaaatgaggtgtcatttatttccacagcctcaaatattctagcccttcagcaattggctgttgttcaatataatgtcccttcagttaaggcaagtcttgtctctgaatattcaaacgctgtatttgcaggtaccaacaatgtcttgtctcttaatataacaaataacggtaaatttgattctatctatactgttgacttctatgtggatggcaaaaagcaaaacagcactgaaatttccctaaaatctggtgctaataagggattatatcttattgatgatacaataaggcctattgatgcaagcacagtaaatggggcagacaatcctaaggtcaattatacagttgtcatcattgacaaggaaaaatcaatggtattagatgagattaccataactcctagcctcttatataatggaaatctaggaaaggacttggcttatccggcagagaatatcacttcatttagaaatataactgtaagcggtggcgtgattgtcgatacattagatgattccacatatattaactctcaagcaacaaacagaacagatatttggaatgtaaatgtggctgatggcgatgtatttacagatgcctttgtttatgttccttacaattgggataagaccaacggatacatgccagtttggaatgcaagattcaatggtgttgcagtttcacctcttgtctcctatagggaccaatcaaatataggattcttcggcaagaacggatatggattggtggtctatgatgtgagcaagcttatcaaatcaggggaaaacactttcactttagaaaaagaagctggaatcactgctgtatatccaagcacccttatggcattctataatgcaactagttccaatagcttaaagaccatttatatctataatggtgcagacctattggcaaatgagaataacttcctaaacaggactgttgcatctgacagtcacttagatatctcctcttttaaggaagtaattagcgctaagctttatgtttttagtgccggtgctcaaaaaggtgaaggaaatattatatttaataataaaacatataaagatgtttggaatggtactgtaaacagtgtagatagtttcatcattgatttaggcaagtctccaagtgtgtccaatgatgtgtcctttgtctctacaggctcaaccattatggcacttcagcagctcattgttcttgactattatgtatcctctgttaaggcaaatgtgtcctctgaatattctggtgctgtatttgcaggtaccgataatgtattaaaagttgacttgaccaatgacggtcagggaggatctgtttatgtgcttgacttctatattgatggcaagattgtaaacagcacagaaattcctcttgatgcaggtaaaagcactgaaatctttttagttgatgataaaataaggcctgttgatgcaagcactgtaaatggtgcaaataatgccaaggtcaattatacaataactgtaactgataaggccagcggacttgttttatatgaggccagtctcaatcctattgtattatataatggaaatctaggaaaggacttggcttatccggcagagaatatcagcttctttgatgccataactgtaaatgggggcgtaatcattgatacattagatgattccacctatcttggagcaaaaaccaccggcagaactgatgtctggaaggttgaaattcctaaagatggaaagatagttgatggatttgtttatgtatcatacaattgggataagaccaatgggtctatgcctatttggaatgtaagtttcaatggagtatcagtttcacctgtggcccactatagagaccagtccaatatgggtacttatggcaaatatggatatggacttgtcgtttatgatgttggggagcttatcaaatcagctgaaaacaagtttaccttagaaaaagagaatggaactactgcagtttacccaagcactcttttagcattctataatcgtacagaatcaaataatagaactaccgtttatatgtacaatggtgcagacttattgtccaatgcaaataacttcttaggtagaaccgttgcaagcaatgccgctttagatttggccttgaatccaaatgatgagattaaaagctcaaggctttatgtttttgctgcaagcggccaatctggagaaggaaagctcattgtcaacaacaagacatttaacaatgtctacaatggcagtgcaaatagtgtggatgcctatattattgatttaggcaagtcccctagcgcatctaataatgtgtcatttatagctacaggctcaaccattcttgctcttcagcaattcgttgtggttgatgctatacaccagtccagtgaagagcttcaaaagatgatcaattcagctagggcaggctctacattgaatttgggaagcaacgtattcaaggatgtctcaaatgtaatcatcaataaggaccttacaataacaggcggaacaatatatgcaagagagggagagaccatcttcgttgtcaccgaccgctctgcaggaggtcctaaggaagtgaatatcactggagtcaagttcgttttagataatgcaaacacaattcttcaagcaagggctgtaaacggctccacaccaacttcaattgatgtggcttcaatcaacatcaaaaagaataatatctcttttgttgatgatgatgtggttccagaatcaataaccgttcttgaccttaagtcccaaaggtcttcaattgccccaactagaaacttgaccataagcggcaataatctaattgcaggtatctgtccattcatgtttgaagtaaccagcttcaatggaaaggactctgtagttgttccagaaggaggcaatatcccagataaaaaagcttctgtaatacattatgaagacatggttacaactgccatcaatacaaatattgaaggaagagtgggcaaatactttgaagtgaaccttacagattccaatggaaatccattgaaggataagaaggtccagataggatttaatggtgttgtatatgataggacaacaaatgccacaggaggagtcaagctccagataaaccttggatacaagggaacatacacctttgcaattgcattccttggtgatgattattataatggcagctttgttgtagctaagattaaggttaacactcaaaagacaaagatttccacttcttctaagacatataaggcaagtgctaagaccaaagccatttctgccacccttaaggatgcaagcagtaatcctataagcggtaagaagcttagtttcactgttaatggaaaaacctatagcgctacaactaattcaaaaggcactgcaactgtgaatgtaagcttaagcaagaagggaacttatagctttactgtaaagtatgctggcgatgatatgtatgctggggccacttcaagcagtaaggtggttataaaatag

SEQ ID NO: 708 - DNA, 10357 bp, Methanobrevibacter ruminantium
atgaagaatagaaaatttttgatagttagcttaattcttattgttctaatgctggccttaggatctgcttatgccgcagatttaagtccagtgactaatggaactgtttctggaggtgtggatgtggcaactgccaatccatacgcttctcaaacaggaggccaagaaatacaatctggagaattaagctatgatgtcccggaggatgttagtgatgtccagtatgcaggactctttgtaaatgtttatggagggtctgcacagggagactatggtgcccagtccaatgtctcaataacatccaatggtgagacaagtcaaattgcaagcgaaagtttaaattatactgatggcagtggcgacggcactgtctatatagtaaatgaccacatcaccaaggtctattccgactatcagatgatttataatatcactgatagggttcaaggtgcaaccggtcaaataaagatcaatgtaacaaacaccaaacttgaaggatatgctaattttgatggcagaatcaaattaatcggtttggtctttgcttataatgacggaagcaataatagatttgattattgggtggattccggtcaggcttggtcaaatagtgcggattcagttaccaaagctaattttactgtgggaactgtaagtcctttcttaagtgctaacataagaaatattgcactttcaagcactgacggtaattattcattcaataagcaagagttaactggtggggaactcatctctgattccatgttcaaataccataagtgggatgtaactgacctcttaaaaaacaagacaaataatttaacttttaattcaaccaaatcttttaagaatgtactttctgtcttgacagttacaaagaacttagaggaaatatttgtaagtcctgacggtactggaactggtactactgcagatgatcctaccactatggataaggcagctcctgctttggctaataatggtataatccatgtattggatggtacctacacccaatccaaacgttatgacattagggcaaactactcatccattgttgcagtaaatcctggaaatgtaatattcgatggaaacaattctgttgcaaacattagagtatatggtgccaatgtaactttggacggcttgacttttacacatggtaaaggaactggagggggagtttatttcgatagcgatgcgaatggcggccttgtgacaaattgtattttcaaagacattaataataccggagctggaggagctgtttacatatccggttctaaaaatgttatgattgaaaattgtaaattcataaacaccacttccacaggtactggaggaggcgcaatctacattgctggagacaatgccaccgttaaggaatgcagctttgaaaatgctactggaaaggatggtggtgcaatccgtgtaaattctagagattttgcggttgtaagagactctaacttcactggttgtgttgcaactaccggcggagccattagttgggtaggaaaatatggaaatgtaaccaattgtacatttacagacaatcaagctactggttcaagcaatggtggaggagctatctattggcaggaaaactttggattaatcaataactgtacattcataagaaataaggctcaagtttatggaggcgctgttaattgggctgcaggtaaaatcaacggtacaatagtcaacagcatctttaaggaaaattccgctggaagagatggtggcgcatattattccgctgcaggtgcaaatgaaatgctaattatgtactgctcatttgaagacaatgaggcagatgcaaacggaggtgctatgggcttccgtgcagaccaatgctaccttcttgattgtaactttaccagcaaccatgcaaaacagaatggaagtgctgtaatgctctattccaatgtagccaatttccttggtattggaaactgtaattttgtagataactctgcagacgtattgaactattccattgttaacaatgcaggaaaattaaaattatctgaaaataacatcacaaccaatgatcttcgtgatggaatctacacaaacggttcaatattgactgacgtttatttatatctcattgtcaatgaaaccaatgatgctgcatccaatgtagtatatgcagacatcggcgatgaagtgcctattgacgtttaccttgtagatgacaacagcaatctcattaacggcataggcttaagcgtagagatcaatggaaccaacatcactgaatttgatttggatggatacacatataagacaagctacacaccaagtgaaataggtacttattatgtaactggaaactattccaaggctgagcttagcaatatcctaacaggatcaatcgttgtgggagaggaacctgtttctgctatagaaattgcttttagaggcgaatatgtaaataccacttatgcaggtgtggaaaaccttattgcagtttcattgcataacaccggatctttagatggaaactatcttgttgaattttatgtggatggcgagcttgcaggaactgaagaatctaaggtaaatgctggctacacaagcgatattaactttattgatgagaaaataagggatctaaacgaatcaactatattgggacatgacaatctacaggctaattacactgtaattgttaaggataatgaaacccaagaagttataggggaatccagctatttcccatatgtcctatacaacggttatttatctaagaaatacgaatattcagatgaattcataagctcattcagaaatgtcaccttcaatggaggctatttcattaacaccactggaagctactctggaaatagcaaccctggattgactgacatttggactcttcctgctcttggcgaaggggcaagctttgcaggagcttatgtatatgttgcatatacctgggataagacagaaaatggaccatctgactgggcctccagctttaatgatgagtccatccctattgtagctcaatatagggaccaatccaatatgggtacaagcggttcatatggatacggtcttgtggtctatgacgtttcctctttgattaaggaaggacaaaacaaatactcattaactaaaggggacacagctatatatccacgtacccttgtggcattctataatgtgactgaatcaagcactgtaaaaaccatgtacatgtataatggtgctgatttattatattacggtagctataatgttttggaaagacttgttatgacagattctgtattgaacattagtacagagggcaatgtcctcggatctaatttgtatgttttcgctgcaagcgctcaagcaggtgaaggtaacttgcttgtcaacggcgaaaaatatgaggatgtttggaacggtactaccagctctgtagaagagaaagtctttgatttgggagacaatcctcttgcatccaatgaaatctcctttgtatctaccggatctaccattttagcacttcaacaattcgttcttgttgaatatgaagcttactctgctgacgttacaatagcttctgaatataatggagcttgttatgctggtactgaaaatgcattgaaagtcaatgtaacaaatgacggtttggaaaaagccaattatttgattgaattatatgctgacggtgtaagggtcgactatgaacatgttgaaatcgatgttggcgaaagcaatgtcctaaccttaatcgacgacaccatcaggccagtgactgaagacactgtaaatggcgcagacaatcaaaaggtaaattacacagtctatgtaagtgctgctggaagtcttttagctgaaaagacaatcactcctaccatatggtataacggttacttaggcaaggactacgcttatcctaatgagacaatcagctatttcgacaccattacagttaacggtggagttatcattgaaactttaaatgataccacttatatgggcgctacagttcttaacagaactgatgtatgggagcttgatgtcccagatgatgttgaatttgcagatgcatttatctatattggatacaactgggataagaccggtgcaaacatccctgtcttgaacttaacattcaatggagaaactgttgctcctatggaaagctatagggatcaatccaacttaggcagctccggcaaatacggatacggattaatcgtttatgatgtgtctgggcttgttgaagctggagaaaatacattattaatagaaaaagagtttaacaagactgcagtttacccaagcactcttgtagcattctataaccaagaggtccctgatgtcattacaacagtttatatgtatcatggtgctgacttgttatataacagctacaacctattaggaagggacgttgaaagtaacagcgttttagaagttgaattggttgatgaccttgcatctgcagaccttttagtatttgctgcaagcgctcaagcaggtgaaggtaacttgattgtaaataatgaaacatatgagaatgtctggtctggaagcacaaacagcactaatgtatttggtgtcgatatattggacagtctcaagcaatccaatgaagtctcctttgtttcaactggaggaactatcctagcacttcaacaattcattgtcttcgaatacgatgtcacttctgctaaagctaaagtaagcacagaatattcaaattccgcatatgccggaaccgacaatgtattaaaacttgatttaaccaataacggtacagtagacactgtctatcatattgacttatatgctgatggcgacttggtagacagcatagaagctgaaatcgattgcggtgaaaacagtacactatacttgattgatgatacaatcaggccagtgactgaaaacactataaacggaaacaacaacgctaaggtaaactacacagttgtaatcagtgataatgcaaccgatgagatattggatgaaattacaataactcctgttcttgtctataacggttacttaggtaaggactacgcttatcctaatgacacaattcaattcttcgacgctatcacagtaaacggtggagtaatcattgacactttaaatgataccacctatcttggaactaaaacaaccaaccgtaccgatgtatggactgttgatgttccaaatgatgcagaattcgttgaggcctttgtctatcttgcatacaactgggataagaccaatggcacctgccctgtcttcaataccacattcaatggtgaaactgtcactcctatagctcattacagagaccaatcaaaccttggaaccagctctgcaaaatacggctatggattgcttgtctatgatgtttcagagtacatcgctgcaggcgaaaatagctttgagcttctaaaggattatgatgtcactgctgtctatccaagcactcttgtagcattctatgatgttgaagactcacctatattgacaactgcttacatgttcaatggcgctgacttattatacaatgcatataatttcttaggaagacctgttgaaagtaacagcgttttatatattgattcagttgacgatatcgatgaagcaacacttgtagtatttgctgccagcggtcaagctggagaaggtaacttgattgtaaacggtgatgaatacaccaatgtttgggaaggaacaagcaatagtgcagctgcttatatgatcaatctaactgattccatagctgaatccaataatgtgtccttcgtttccactggaggaactatcctagcccttcaacaatttgtcatagtttcagaatacgccccatacgctaaggctgacattatctctgaatataagggcgttgcatttgcaggcacaaacaatgtcttaaaggtcaatgtaacaaacgttgctgaggaagatgctgtcttcaatgtaaccctttatgctgacggcgttgaaataggcagtcaattgattgaagtaggcgcttatggcagtgccattgcaatgtttaccgatgagaagatcagaccggttacagaaaacacagtcaaaggggcagacaatgaaaaagtcaattacactgcagtcgtaagagatgttgacgaccttgttgaggatgctgaagctacaatcactccggatatcctctataacggtaacttaggcaaggacttagcatatcctgctgaggagatcacattctttgactccatcacagtaaacggtggcatttacattgaaatccaaaatgattcaagctaccttgcatctggagctaccaacagaactgacatatggaacattgaagcacctgaagacgctgatttcgtagctggatttgtatatgtggcttacaactgggataagacctctgcaggaatccctgcacttaacatcacattcaatggtgtatctgtcgctcctgttgcacattacagagaccaatccaatatgggaacctatggcaaatatggatacggacttttagtatatgatgtaagcgaccttttagaagcaggggataatgtattcaccttaacaaaagatgctaacatgactgccatctatccaagtgttttggttgcaggctacgaccaagaagtatctgacagcatgaaaaccatttacatgttcaacggcgcagacttattgtccaatgcaaacaacttcttaggaagagttgttgcatctaacagtgttttagacattgaattgcctgatgatgtaattgattgtgcacttggaatatttgcagcaagctctcaaaaaggcgaaggcaatctaatagtaaacggagaaagctttgaagatgtttggaacggatcttccaactcagtccaagcttgcgtatttaacttgacagatgatatcgaagaatccaacacagtatcatttgttgcaaccggaagcactatactagcccttcagcaattcatctttgtggaatacgagcttgtttctgttgacgctaaattaggctctgaatacaataacgttgcatttgctggaaccgacaatgtcttagaatttaacattaccaatgacggaacaattcctaccgcatacaccattgagttctatatcgatggcgaattggcagacactttagaacttgaacttgcaaacggtgaaagcgacagcctataccttgtggacccaaccatcagaccagttgatgaaaccactgtaaacggcgcagacaatgctaaagtcaactacactgttgtaatcacagacaattcaactggagatgtcttagatataatcactatcactccttctgtactctacaacggtaacttaggcaaagacttggcatatcctgctggagaaatcactttcttcgatgtaattacagtaaatggagatatcattgtcataggaatgaatgattccacttatcttggctctaagacaacaggacgtactgacgtatgggacttaaccactaatgaagatattatctttgcagccggatacctttatgttgcatacaactgggataagacccctgctggaatgcctgtatggaacaccacattcaatggcgtaactgtcactcctgttgcacattacagagaccaatccaatatgggaacctacggcaaatatggctacggacttatcgtttacgatgtatctgaccttattgtagctggtgaaaacacattcaccttagaaaaagaaaatggaaccactgcagtatatccaagtacccttgtagcattctataatatgcctgaatccagcacttatgtaactacatacctatacaatggcgcagacttattatccaatgcaaacaacttcttaggaagacttgttgcatctaacagcacattggatatcgattcatttgacaatatagtcggcgctgaccttttagtatttgcagctagcgctcaagctggagaaggtagccttgtcataaatggcgatcttgtagctgacatctggaatggcagcagcaacagcgtagatgcatatgctattgacttaggcaaaaaccctaaggcatctaatgaggtatcatttgttgcaaccggatctaccattctagcattgcaacagttcattgttgttgaatacaatgttccttcagctgaggcaagcctcgttagcgaatattctaatgttgcattcgctggaaccaacaatgtattgcaattcaacttaacaaacaacggcgctcttaacacttcttacattgtcgacttctatattgacggcaagaaggtaaacagcactcaaattgcactcaactctggcgaaagctttggccaatactttatcgatgatacaatcaggccagttgacgcaagcactgtaaacggcgcagccaatgctaaggtaaactacacagtcttagtcagcgataaggataccggacttatattggatgaagtgaccctcactccttctgtattatataacggtaacttaggcaaggacttagcacatcctccagaagaaatcgtcctatttgacacaatcactgtaaacggtgatgtgattatagatacattagatgattctacctatcttggagctaagacaaccggacgtactgatgaatggaacttaaccgttccttcagatgctgatttcgaagtggcatacctttatgttgcatacaactgggataagactgcaagtggaatgcctgaatggaacaccaccttcaatggtgtaaatgtcactcctgttgctcattacagagaccaatccaatatgggaacctatggcaaatatggatacggactttacatttatgatgtatcagacctcattaaggcaggtctaaacacattcaccttaggaaaagaaaacggaactacagcggtatatccaagtactcttgtagcattatataatgttaacgagtcaaatgtacttactaccgtttccttattcaacggtgcagacttattatccaatgcaaacaacttcttaaacagaactgttgcaagcaataatgtcttagaattagatttcactgtatttgatgaaatcctatccagccaactctatgtatttgctgcaagcgctcaagctggagaaggaaaccttattgtaaacaatgaaacattcactaatgtctggaatggaacttctaatagcgtagatgcttatattgttgatttaggaaatgaccctagcttatccaatgatgtatcatttgtagctaccggttctacaatccttgcattagagcaatttgtcgttgtaaaatccaaatatcaaaccagctctgacttgcaaaaactcatcgatgctgctgaacctggatccaccttggatttaggtgacaacgtattccaagatgttgctaatgtagtaatcgataagaacttaaccatcaaaggcggttccataatgggcaaagctggagagaccatctttgtaattccagcaaaatccgctaacggtcctgatgaggtaaacataactggcgttgactttattgtggaagatgcaaatgtaattgttcaagcaactgctgacaatggaagcagcccaacttcaatcgacactccaaacatcagaatcagtgacaacttcattgacatgatagacggaagcgttgtacctgaatcagtaactgtattgaaacttgacagcgaaagaggagtccttgcacctaccggtgaactcaaggtcactgacaacgcaattgcagctggaatcaaaccattcgagtttgatgtaactggcgtatccaacggcagcgacaccaatattccagaaggcggtaacattcctgctaaacaggcttctgtaatccactatcaagatatggaaacaactgctgttaactctaagattgaaggaagagtgggcaaatacttcgaagtcaacttgacagacacaaatggaaacccattagcaaataaatttgtccaaataggtttcaacggtgtagtatataacagaacaacaaacgaaaccggcggagtcaaactccaaatcaacttaggatacaaaggaacttacacctttgctatctcctaccttggagatgactactacaacggtagctttgttgtatctaagatcaaggtaagcacacaaaacaccaagcttactactgctgcaaaaacctataaggcaagcgctaagacaaaaacattaactgcaacactcaagtcaagcgtgtacaacaaaccaatcaacggtaagaaagtaactttcacagtaaacggcaaatcctactcagcaactacaaacgctaaaggtgtagcaactgttaaagtaagcctttcaaccaagaaaacctacagtttcacagccaaattcgctggagacgatatgtacaccaaatcaagtgttacaggtaaggtaactataaaataga

SEQ ID NO: 709 - DNA, 3285 bp, Methanobrevibacter ruminantium
atgaaggtcttaaagatagcaattatcatgcttattttaatcatatctctgggagcggtttcagcaacagagaattttaataatgatttaagtgataatggactaaacgataacacattaagcgacaacagcttaaatgaaaataccttaagcgacaacactttaagtgataaaagcttaagcgaaagcacaatcatccaaaatgatcatgataatttaaaagatacaaataataatgataataataaagctctaaaagatcctgcgaagacatttacagacttacaaatggaaataataaatgcaagtgaccttttagaattgacagacgactataaatacaacaatgaaactgacaatatcacattaacaatctctaaaagcaatttcgtaattaacggaaatggccatacaatagacggagacaatcaatgtggcattttccaaatcaacggaactaacataaccctaaaaaatctcaatataataaatgcaaactctacaaaggacagcgccctattactcaacccaggctctgagcttgagacaaacaatgtaaccttcatcaacgacagctcagacaaaagagtaatatttgcatttggagcaaaatatacaagcaataatgataagtttatagactgcacatccctcaatgatggagtaataaactcataccttggtgaaataactatcaacaacggatattttgaaagctccaagccattggactgggctttcgtcaacagtttgggaaattcctcaatctacgttttaaacacaacatttgcaaataccacctccaaatacgctacagcaatcaagggagatcgagaaacagtaattcatgattctaaattcattaatctctatgcaaaccttactgcaggagcaataggattaaaaagaattgaagaggctgaaattgacaattgcacattcattaatgtgagttcacaaaaaaatggaggggcaatattccttgacatatattcagatagcgaagacgtaccaataatgatttcaagatcctcctttgttaattgctacagcgaattcggaggagcaatcctctctttagggggaaaaatcacattggaggaagacaatttcacaaacaatggggcattctttgacggaggagcaatctattcttccttctcacagcttacaatttcacagacaatctttgacaataactctgtagaattagatgatgatagaggttcctttggaggggcaatattctctgacattagcgcattgattatattgaattgcagcttcagcaacaataacgcccaaactggaggagccctatatacatatgattcaggctactacattgcaaactccactttcaaagacaataccaacaaagagagtgagtttgatgatatcttcacagacttcgatggggaaatcgccacacttgaaaacaatagctatagcggagaggattcaatatgcctgaacaacgaaaggtatgaatcagtaatcgccgtttctggaatgaactttaccctcatagaaaatgaaatcaatgtgacaaaccctcctcggaaatttgacctacgtgaatggggatgggtgactccagttaaaaaccaaggctacatgggttcatgttgggcatttggaactgtaggagctatagaatcttcaatattaagatttttaggccttgaaatggacatctctgaaaacaacatgcaagacagcttattgcaatattatcgctatggaaccctaggagcagaagaagggggagagtataacctaggcccttcctatgcattaagttggtttggagtattcccttcagaatatgacgtttacgatgagcttggaaagatttcagcaataatcgcaacagatgacagcatccatttgcaggacgcagtctttgtgcctcctcttatgaattccactgacaaggataaattaaagcaatcccttttaaaatatggcgctttagcagtaagctactatgccgaaaccgatgaacctggattaaatgagaatacctcatcacaatacagcctaaaaaatgatagtaaccatcgcgttcttttagtgggatgggatgatgactattccaaggacaatttctatatgacccctccaggagacggagcttggataatcaaaaacagctggggagaagaattaggagataagggatactattacatatcctattatgacgcaagttttgcaaccctagtgccttctgtcggattcccaataatgaatacagtcatttacaataaaaactatcaatatgacatcggaggcacattggaattcactgatatgggaaatgaatacgtcaatgaatttgaggctttggaagatgatttcattgcagcagtcggaacatacttcattgatgctggcgtcgattacaacatagagatctatgtcaatgatgaattgaaatacagccaagatggaacttcaccattttttggattccatacaatccaattggattcatatgtccctatcaaggaaggggatgaatttgacgttaagatcacatcagactgcattccaattttagaaagtggaagacagcattatatagaaaacaagtcagctgcaaatctaaatggagaatgggtagaccttaccagtgacgggaaagtctgtgctataaaggtatatactacagatgaagacaagaaaaaggaatcttctagaatcaatacaagaatagactgtaaaaacatgacaaccactgcagtggcatctgaagacggcagaataggagaatacttccaagttactttaaaagacgaaaacggaactgctttagccaataaaccaataaagataggtttcaatggaagggtctatgatagaacaacagatgaaaacggcagtgcaaagctacagataaaccttgcttacaaaggcacatacacctttgcaataggattcttaggagatgaggaataccttggagcatttgaagttgctaagattactgtaaaagtacagacccctaaattgactgccccaaataagtcatataaggtaagtgcaaagacaaaaagccttactgcaagcttcaagacagcaaacggaaaggccgtaagcggtaaaaagataagtttcacagttaatggcaaaacatactcagctaaaaccaattccaaaggaactgctactgtaaatgtaagcctaaacaagaagggaacttatagctttactgtcaagtttgcaggtgacgatacatttgctacttctagtgcaaaggctaaattgacattaaaatag

SEQ ID NO: 710 - DNA, 3978 bp, Methanobrevibacter ruminantium
atgagattaagatattttgcaataattagtttaattcttttaatatttttagttccagttagttttgcaagtgaaactaatctggattcaatagaattaaatgatttagctgattcttctactgaaatagatgattctactgatttaaatcaggattatagttctaatcaagatttaagtcttaatcagaattctgattctaatttaagcaatgaacaagaattatattctaataaacttagtgaaaactctctagattcaaattcacaaagttcaaatgatttatcaaactccttatatttgtcttcaaatggagtaaggctagctgatttgaattcaagctttgcccagttcaatacaagccttaacgattcaaatacgatctatgtaaactcatcctatattggttctgatgagtttggaactcaatctaatccatataagacagtattggctggaataaatgctgcaactactgatttaaataatgtctatattgcaaatggggtttataatataaatacaacaataactgttttaaaatccataaatataataggagaaagtcttaatgttatattaaatgcttccaacgaaaacaatatcttatcagttaaaggaagctctgtagaggtctcaatattcaaccttacattcaggaatggctatgcaaataagggaggggcaatatatgtggataaatcttccctaaacattattggaagcctttttgattcaaacattgcatatgtcacaagcgataacggatatggtggggctatctacaataatgcaggctttttaaagctctataacaccacattcaaaaacaataaggtggtagcagcatacaacatagtctctgaaggttttggaggtgcaatctataatgagcttggtgaaatgactgttcttaattctaagttctataataactcaatagacataagaaacatatcaaaatcatcatatggtgctggaggagcaatattcaaccgtgcaggatttgtcacaatattcaactcaagcatcagcaataattcaatctatacaaactactcacttggaggggctatctccatctgggcaagccgcaatgtctatataatcaattccacaataaacgacaacataattagcggaagttacggcttcgcttcagtgatttcaaataagggaaccctccttcagatagaaaactccacaatctcaaacaacaatataaatgcaagctctgtggagaattcaacaatctacaatataaacggcaatttcaatctgataaactctaagatggaaaacaataagataaagacaattaagaccaatctccttatgtgtcttgaggatcagcttattgtaaacagcagcttcaatctggcaaacgagttaaaaggccttaatatgacttccttaccttcccattacgacttaagggaggaaggattggttactgcagtaaagaatcagggaagctctggagcttgctgggcatttgcattctactctgcaatggaatcatatcttttgaaggtggaaaacataagctatgacttctctgaaaacaatatgaaaaactgtatgggagacggcagcgaaaacagtaccgactgggatgacggcggagcatatgtggttgcacttgcttatcttctccgttggagcggagcgataaacgaaacagacgatccattcaatgcccgctctaaagtttcccctaccaatctaactagggtcaaatacctcactgatgcattatacataccattgcgtcttggagcattggacaatgaccaaatcaagactgctatcctaaagtatggtgctatatttgtgccagtatattcaaatatcattaaagcaaattccaaatcaggatattccgatatccaatatatctgcaatcatgcagtggcaattgtaggttgggatgacaactattcagcaagcaactttaaggacactccacctggagacggcgctttcatcataaaaaacagctggggaacaagcgggggagaacagggatactattacatttcctattatgacgcttcatttgcagcttcaatagagacatctgctgcagttgctgtgacaaatgttgtaaatacaacaggtgaatacagaaacaactattactatgacacattcggcaatacatttgaaaccataggatacaattcagatacaatatggtttgcaaatcagtttactgccataagtgacaatcctttaaatgcctttggcctttatacctatggagattccacatatacagtaaacatcactgtaaacaacaagtcagtttacacatctagcggaaagatagtgggagcaggcttccatacaataaagctaagcagatatgttccattaacaaagggagacacattcagaatcatagtaaagcttacaaccccttccactttattcccacttgccgttgagacaaactacagcggatttaccccaagggcaaagtccgactacaaccagtcattcataagcccagacggtaagacatggtatgaccttagaaatagctctaacaacagggctgtaaagttctatgaggatatgtatttctatacattaaagaatgcaagcgtttgccttaaggcatatactgcatttgccgatgaattggaattgaacttatcatcaaacagtcctatttactacacgggagatacaattaaacttaatctcactgtcactaaccgtggggatttggcaagcaattcatctatagcggttcctttagacaagtcttatagcatcgtgtcctataagatatctgaaaacaatgggaataagtcatatgatattcattacaatggttcaagctttaatatggctagtggaatttggtccattccttatttggaaaatgaggagtctgtaagcttaatcttaagtcttaagatgaattcaaataatgatgttaacattaaagtatcagcaaacagctcttcatgcagcgtaaaggacaatgtatatgcaaatatttctctaaaatataagattccaagcaagtttgcaaatattccatccataaatacaactgcaaggtcttatgggctcttaaactttacattgttggatataaacaataagcccctagcaaataagaatgtgaatcttttgctcttaaagttagatgatgaggaagatgaagacttaagcttaaatgatactaatttatattattcagattcaagcatttctaatgcttcggtaatatccaatctgaccttaaaaaccaacggcaatggaattgtacagtacaaattgaatcttacattgggagaatacctattcaagcttgcatttgatgaggacaagaattatcaagcttcagactacaattattccttaaacataacaaagagaaagtcaactaagatcctttgtaaggacatggtaacctattcagtcgttgcagaggtggatggaagaagcggagaatacttcaatgtcacattgacagactgtgacggatacgctatggcagataagtttatccaaattggattcaatggaaggatatataacagaaccactgattccgagggcaaggcaaggctccagataaaccttaagaatccaaatgcttacacatttgcaatctgtttcctaagcgatgatgactattatgcctcatttgaagtggctaagataactgtaaataagaagaaaatgtccttgaatgttccgaataaggcttataaggcctctgaaaagtcaaagattctaacagccacactgatagaaaacaataagaagacagttgcaaacaagttattgacttttacagtcgatggaaagacctattcagctaagactaattcagcaggagtcgcttcagtcaaggtaagcttgtctagcaagaagatttattcattcacagtcaaattcgctggagatgattgttatggttctgctaccaagtctgcgaaggttattataaaatag

SEQ ID NO: 711 - DNA, 891 bp, Methanobrevibacter ruminantium
atggtaaattatgataaggttgaagataccttctttgaatcatttgatggaatgtatataagagcattgattacagcagaagacgaattgactgtaaaggaagcagcatatgatgctacagctactccaagtgcagttattggcagggttgaagcaggtgtagagtcctttgtaagtggagataagactccagacggaaggcctggagccattgttcagttctggcttaccgatgacttggctaagtttgaaaaggaactgtcctataggattcgccaggacattcttgtaaagccatttacaagggtattcagcataactgaaaatccggtaggttcaattcctatgatggaaagcgtaggccattgcggtgacggctatgaatgggaaatcgaggagtatggaagaaagatgatcaatgttcctattgcagttcccgattttcaaatcgagtcagagcttgcttatgcagaaggaatcatgggaggaaacttctggtatatgtgttccactaaggaagctgtattgaaggcaggaagaataataatagacaccattatggaagttgatggggtctgcactccatttggaatatgctctgcagccagcaagcctgaaacaaacttcccagagattggtccaagcactaatcatccttattgtccttctttaagggaaagacttggcaaggagtcaaaggttccagaaggagtaaactatattccagagattgttattaatgcagtaagtcaggaagctatgaacttggctattaagaaggctgttgatgccattattgacataggtggtgttgaaaggatttccgctggaaactttgagggccagttaggagagcataagaccaatttgcttgatatcttaaaggaatga

SEQ ID NO: 712 - DNA, 933 bp, Methanobrevibacter ruminantium
atgtttagatttgataaagaacaactcgtcgtagatattgctggagtaaaaatgggaggacaacctggagaataccctaccgttttagcaggaactatcttttacggcggacacaaaattattagtgatgaaaaagcaggagactttgataaagacgctgctgaaggattaattaaaacaatggaagaaatgtctgatgtaaccggaaacccttgtgttgtacaaactttcggtgctactgcagaagctatggttaaatacttagaatttgtaggggacatctgtgacaaacctttccttatcgactcaactgctgcagctgcaaagattgcaggtgtagaatacgtacaagaagcaggattagctgaaagagctgtatacaactccttaagtatggcagcagaagctggagaaatcgaagctgtagctaactctgacatcgacgcatccattctcttaggtttcaacccaatgacccctggtgtacctggtaaactcgaaatctgggaaaccggtggatctgttatcgacgaaggtattctcgaaatggcagaaagatgtggtattaccaaaccttggatggacgtagcagttactcctttaggtcaaggtgcaggtcctgcagtaagaacttcctacgctgtaaaagctaaatggggataccctgtaggttccggtattcacaacgtaccttccgcatgggattggttaagacaatacaaaaaagaacacaaagaagcatggcctgtatgtgatataggttctaacatcgtacaacaaatggctggtggagacttcgtacttttcggtcctatcgaaaactcaagactcgcattcccagcatgtggtatggcagatattatgattgctgaagcagcaagagatatcggtaccgaacctattgaagcacacccattgaacttgttattataa

SEQ ID NO: 713 - DNA, 252 bp, Methanobrevibacter ruminantium
atgtctgaagaagaatcagtacctcaaattattgtatctaccgatgatatggcagctgcaattaataaattggatgaagctgaagaaaaagtagaattcgctgttggtgaatacttccaacgtttaggacaacaaaacggtagagatattggtattttatatggtattattttaggtcttgtaattttaatagtatctattgaatttggtttggtaagtgcaatgagtactatgcttacaagcttagtctaa

SEQ ID NO: 714 - DNA, 207 bp, Methanobrevibacter ruminantium
atggttagattttcaaacaaaccaaatactcgtggtattagaaatgcttctaataatgtagaataccgtgcaaagctcttaggtagagaaggaagattatttgctggcgtaatcagcaccagattttctggaatggctattggtattggattagctcttgctttagcagttgttattccatacttagctaaattatgtggtttatag

SEQ ID NO: 715 - DNA, 738 bp, Methanobrevibacter ruminantium
atggctgacaaaaaacctgctgctgataactggcctgtagtaagtggagactacattgtaggggaccctgaaagtcctgttgctgtaactaccttagcttctcacaatgaagatattccagctgctgctggagcagctattgctggaccttgtaagactgaaaacttaggtattgaaaaagttgttgcaaacattatttcaaacccaaacatcagattcttaatcctttgtggtgctgaagtgcaaggtcacattactggtcaaagtatccaagcattacatgaaaatggttgcgaccctgaaaagaaaaagatcactggtgctaccggtgctattcctttcgtagaaaacattcctatggaaggtgtagaaagattccaacaacaagtagaacttgttgacttgatcgacaacgaagacggtggagcaatcactgcaaaagtaaaagaatgtatcgagaaagatcctggtgcttttgaagaagatgctatggttattgaagtgaaagaaggagatgacgacgaagatgaaggtgaagaaattcgtcctatttccgctgaaactgcattacttgaagcaagaatcagaaacattgacactcaagtaaaattagttggtgctgtacaaagaaatatggcaggtaactattcaggaaaagtccaaggtatcatgattggattaatattcactttagtaatcggtttcttgttattaatggcaccattattaggtgcataa

SEQ ID NO: 716 - DNA, 321 bp, Methanobrevibacter ruminantium
atggtattacctttaatacaatttattcctgaattaaacttaaatcttgatcctgaaaccggtcttctcggtgcaggtggtggagatttaatcattctttcaatggatgagataaatggagaaatcgcaaaagtcgaagcggctgctgatgaattaatgaattccttagatcctaattccgcaccattaggttccttcccaggaagagaaggtaactttgttattgcaggaacattgaccaatatggtttatggatttattataggaatgttccttatcatggcagcaatgcctatattaacagctatgggggttttatag

SEQ ID NO: 717 - DNA, 702 bp, Methanobrevibacter ruminantium; identical to SEQ ID NO: 703

SEQ ID NO: 718 - DNA, 702 bp, Methanobrevibacter ruminantium; identical to SEQ ID NO: 704

SEQ ID NO: 719 - DNA, 873 bp, Methanobrevibacter ruminantium; identical to SEQ ID NO: 705

SEQ ID NO: 720 - DNA, 660 bp, Methanobrevibacter ruminantium
atggcacaatattatccaggaacttctcaggtagctgaaaacagaagaaaatttactaacccagatgttgagttagaagttttaagagaaatatctgatgaagatgtagtaaaattattaggtcacagagctccaggtgaagaatacaaatccgttcacccacctctcgacgaactcgatgaacctgatgacattattagagaaattgtagaacctattgacggtgcaaaagcaggagacagagtaagatacatccaatttgtagactccatgtactttgctccagctcaacctttcttaagagcaagatcctacgtatacagatacagaggaatcgataccggtaccttatccggaagacaaattatcgaagctcgtgaaagagatgtagaaagaatttctaaagaaattttagaaaacgaatactttgacactgcacgtactggaatcagaggtgcaggtgtacacggtcactctttaagactcgacgaaaacggtttaatgtttgacatgttaagaagacaagtactcaacaaagaaaccggtaacgttgaaatggtaaaagaccaaattggtcgtgaattagacgaacctgtagtattaggtgaaccattagacgaagaaactctcagagctaaaaaccacaatctacagatgtga

SEQ ID NO: 721 - DNA, 597 bp, Methanobrevibacter ruminantium
atgattggaagatgcacacatcttgtagactgcagggaaacaagaggacttggtgaaggaggaggaattgcccaaagaggaacttttgcagaatgtggaagcgatgttttggcagttgcaatgtctccaggtagaagacacattaccaagccagtctgtgaaatcaccttcggtcttcgcgaagccaacctattgaccagcaccatgatattggatgcaggaagcggcgtaccgcatgatgctcctgctggaggtgccggtaatgcattcggcttgactgacaaggaagtcgagcagatgcaaaagttcaaggtcattgtggttcatttaggtggagtgagaaatcatattacatacaaagcaagacttatcttgcgtaacgttaacaaaccttgtgttattatttgtgaatatcctgtagactttgaagattttgcaaaaatcggtgtcaaaaccgcaaaggtcatgcctgatgaggtaaagacagaaggtaaaatcatgaacatagtatcaggggttattaggggacaaacagtctctcaagaaaaattagatgagattattagaaaagttagattaacattaggagatgcataa

SEQ ID NO: 722 - DNA, 456 bp, Methanobrevibacter ruminantium
atggatattgaaatatttccacacagaattttaggtacagacacaactgaaaaggtattaaatgatttagaatctttagattcagttaaaagaactgtaattcaagggccaagactcccaccacaagatgagattgacagaatctatggagatcgcagaatcattgtggtaaatggcgaagaagttgaattaaaggttaaaactggtagaatttttgtagaactctatgatgaatctggtattgaggaaattagagccatatgcgataagcatattgacactggttttgatattaatactagcaaggctcaatacatccgtaagcaaaaaacagttactgatggattgaaatatggtgaaaatacagaaattcctgaagaactgattggtatcgcagatacccgttctaaatttaatgaacatgtctctattctaagaaaagatggtctggaataa

SEQ ID NO: 723 - DNA, 1024 bp, Methanobrevibacter ruminantium
ttggcaaagtttgatgataaagtcgatttatacgacgacagaggttcattagtcgaatctgatgtaccaatcgaagctctaagtccgttacgtaaccctgctattaagaacattattagcggtgttaaaagaactgtagctgtaaacttagaaggtatcgaaaaatctttaaaaactgcttccgttggtggagcaaaatctaaaatcttaggaagagaaatggatcttgacattgttgctcaagctgactccattaacgcttctttaaaagaaatgcttcaagtaactgaagacgatgatactaaatgtgaaatactctctggtggaaaaaggattttagtccaaattccaactatcagattagattcttccgcagaatactccgtagcaaccttagctaccgcaactgcattaacccaagctattatcaaagagtttgacgtaagcatgtacgacgcaaacatggtaaaagctgctatcttaggaagatacccacaatctgtagaatacatgggatccaacttaaaaaccatgttagacgtaccacaaaaattagaaggtccaggttactctttaagaaacattaaagcaaacgacttcgtagctgctaccttaaagaatactttacaagcaactgctcttgcaagtatctttgaacaaactgctatgtttgaaatgggtgacgcagtcggtgcatacgaaagaatgcacttattaggtttagcttaccaaggattaaacgcagacaacatggtattaggtctcgtacaagacaacgcaaaagaaggaaccgtaggttctatcgtacaagacaccattgctaaagctgaagctgatggtgttatcgctgtagaaaaagaattaaccgactacaacatgtacgcaaccaacgatgcagctaaatggaacgcatacgctgctgctggatgtactgctgctattatggttaacgtaggtgcagcaagagctgctcaaggtattccatctactattttatacttcaacgacaacatcgaattcgcta

SEQ ID NO: 724 - DNA, 888 bp, Methanobrevibacter ruminantium
atggaaattaatggtgtagaaattaaagaaacttacgcagaaggattcggaattaaagtaactagaattttagtaactgcagcaactgcaaaacttgcaaaaattgcagcaactgaagctactggttatgcaacttctgtaatcggatgtcctgctgaagcaggtattgactgttttgtaccatctgaatgcactccagacggaagacctggttacgcaatcatgatttgtcacgcttctaaaaaagctcttgaccacgaattaatggaaagaatcggtatgtgtgtcttaactgctcctactgcagcagcattcaacttactcgaatctgaagacgaattaaaaaccgctttcaaactcaaatacttcggtgacggtttcgaaaaagactgttgcattgacggaagaaaagtacactccatcccaatcatgtctggtgacttcattgtagaatccactttcggattcaaagcaggtgtagctggaggaaacttcttcattttagctaaagaccaaattactggtgttaaagctgctcaaatggctgttgcagctattagaaacatcccaggtactatcactccattccctggaggtatggttgcatccggttccaaagtaggatccaacaaatactcattcttaccagcatccactaacgaaaaaatgtgtgtaactttaaaagaccaagttgactctgacattagagaagatgctgaaggtgtatttgaaatcgttattgacggtttagatgaagaatctgtcaaaaaagctatgaaagcaggtattgtagctgcttgttcagttgacggagttcttgaaatcagcgcaggtaactttgacggtaagttaggtgcatacatcttaaacttacacgacttattctaa

SEQ ID NO: 725 - DNA, 849 bp, Methanobrevibacter ruminantium
atgtgtgatattatggtagttaaaattggtatcgtaaaaagtggtaatattggtacttcaccagtattagatttattattagacgaaagagcagacagaccaaacatcgatgtaagagtatttggatctggagcaaaaatgaaccctgaacaagttgaagacgtcgtacctaaactcgaccaattcgaccctgacttctgtattttcattagcccaaacccaggagcacctggtccagctagagcaagagaattattatctgaaaaagatcttcctgctattatcattggtgacgcacctggtaaaggtaaaaaagatgaaatggatgaacaaggtttaggttacattattgtaatgtccgacccaatgatcggtgcaaaaagagaatggttagacccaactgaaatggctatctttaacgctgacatcttaaaagtattagcagaaactggtgctttaagattagtacaaaaaactctcgacgctgttattgctgctgctgatgctggcgaagaaattgaattacctaaactcattgttactgctgaaaaagctgttgaagctgcaggatttgcaaacccatacgcaaaagcaaaagctatcgctgcatacgaaatggctggagctgtcgcaggcttagacatgaaaggttgtttcatgaccaaaggcttcgaaaacttcatcccattagttgctgctgcacacgaaattgcatctgctgctgctaaattagctcaagaagctagagaaattgaaaaatccaacgacactgtcttaagaactcctcacatgaaagaaggaaacttaggttgcaaagttgatttaatcagcaaacctgtagacaaataa

SEQ ID NO: 726 - DNA, 450 bp, Methanobrevibacter ruminantium
atgccaaaacatatcgtatcaggactaaaatatttagaaagtgtcgagcttagaaaaagagggctgtcccaaaaggagatttcatctgaaattggtgtggacagatcaactatttctcactacttgaacggccgaaacatttctgccgattcaatcgagcttgctaaagttattttagagctgaatcctaaggattttatattaattgcaagagttttgtttggagattataacgaaattcgtcaacttattagcatttttaatatgaatcattatgacccgcagatagatgacggatgtattggttgtggattgtgtgtagatttgtgtgaagtgaagtctattagcttagactcattaaaagcaaagataaaccctcgttattgttgtggctgtcttatgtgtgttgaagattgcccgacaaattcaataaagattttggaggtataa

SEQ ID NO: 727 - DNA, 1024 bp, Methanobrevibacter ruminantium
atggtcaaaaatattaaagaaacagaaggcaaaaacttctgcattaaaagatcattaggcgaagaaagagtattgtctttcaaagatcacgtctgtgtcggttgcggactctgtgaagcaacctgtcctgtagaagctatctctcttgatgaagtagctcctatcgaacgtaaatatgtagacacttatttcagtggtcatgaaaagattgctcaaaactatgctcttttcactaatgataacgaaatcaaagcaaaattagatatttgcgaagataaatgtgttctctgtggtttatgtagtggagtatgtccagcaggtgcattagaacttgctattgatggcgtatccattaaagaaaatgaagcttacccacatcttgtcacttcagctgaaattgatgaagacaaatgtttattctgtaagaaatgtgaagctgcatgtcctagggagtcaattactatcgacagaaaattacctaaccgtgcagaccttgtaaccggtgaaatcgaagtggatgaagaagaatgtatctactgtggcgcttgtgctgaattatgtcctgctgaagctatcgtagtggacaaggcaaccggcgaagaaagcattgtcattgacaaggaaaaatgtgtatactgtctcgtatgtaagaaagcatgtcctgttgacgctatcaaagcagtatgtagatcctgttcctacggcgaatacgatcttgaccctgctaaagcagcaattacaggtaacgctatcattgattctgaaacctgtattaaatgtggatggtgtgaaggagtctgtcctgctgatgcagctactgtaaaacaagcattcaaaggtactctcgaaatcgacgaagaaaaatgtggtacctgtggagcatgtattgacgtatgtccatgtaatgtcttgtccttccctaaatcaactggtcctggagacagaggaactcacttagttaaagaagaagattactgtatccactgtggtgcttgtgcaaaagtatgtcctaacgaagcattaa

SEQ ID NO: 728 - DNA, 231 bp, Methanobrevibacter ruminantium
atggaacttaaagtagatcaagataaatgtttaggttgtggagtatgtgttatcgcatgtcctgtaaacgcttccatcagtccggaaaacgctggaggacacggttccaaaacaaccgaaactattatgatggttgaaaacggatttattaaattattcagtgtggacaaatgtgataaatgtggtacttgccaaatgttctgtccaactgaagctatatggttagaatag

SEQ ID NO: 729 - DNA, 537 bp, Methanobrevibacter ruminantium
atgcattacgcaaatacttatttagaaagaccagtagttggagatttagaaaacgtagctcaagaaggtactaccaaagtactcaaatgtatgttaaacaccggttctgacatatatcaaggagcttgtaagaaaagaggttccaccttaaaggaagaatataagaacgcttccggtacctgttatatggatcctcgtgacatggtaaaattaggtgttaaaaactgggacaccgtacttgtaaagactgactatggtgaagttgtcttaaacgcagcaaaatcaagagatgctcctcacgaaggtaccatttttgtatgtaaaggtccatgggctaacactatcgtaagccacgaaacctactgctgttcagaccctacctacaaaggtattcacgctactgtagaaaaaaccgacagaaaagttctactcatggcagacttaatgagatgggcatacaaaaaatatgttgacgaagaagatgacgacgttattgaaaacatggaatccttaggtgaaagaccagtttataactga

SEQ ID NO: 730 - DNA, 1024 bp, Methanobrevibacter ruminantium
atgacatatgagccacctgtaactgattacgattatattgtagaaaactgtacttgtgcattttgcggttgtaactgtgacgacttagatttcttagttaaaaacggtcacgtggttgccgtaagacacgcatgcagattaggtgcaagtaaggtaatggaagatatggaccaaagattacttgtgccaatggtaagaaacgaagaaggagttcttgaagaggttgactgggacactgcacttgacactgcagctgaatacattgcaaactccatcagacctgtattctacggttggtctgaaacttccaccgaatgtatgaaagaaggtgtggaattaggagaatacatcggagcagttctcgataaccaagcaaccatctgtcacggtccaagtctacaagctatgcaaaacgcaggttaccctatccaaaccttaggggaagttaaaaacagagctgacgttattgcatactctggaagcaacgctatgaactctcacccaagacacttagcaagatatgctgcattccctcgtggatacttcagacaaagaggaagattcgacagaaccgttatcactatggaccctaaattctcagacactgcaaaaatgtctgacaaatggattggtttcgaacaaaacggtgactacggtttctacaacgctttaagagctgtactcaaaggtaaaaagttacaatctgaatccgtttccggtattccagcagaagacatctatgaattagctgctgaaatggaagctgcagaattcggtgttctcttcttcggtttaggtttaacccacaccttaggtaagcaaagaaacattgacatcgcgattaaattggtacaagacttaaacaccaacagtaaatggggactcactccaatgagaggtcactttaacgtaaacggtttcaacatcttcatggcttacgaaaccggttgggcattcggtgtagacttctgtagaggatacggaagatatatgatgggtgaaaccaacacaatcgacttactcg

SEQ ID NO: 731 - DNA, 1024 bp, Methanobrevibacter ruminantium
atggaatatatacttaaaaatggtattgtttacgaccctgctaatgaagtaaacggagaaaaaatggatatctgcttcaaggatggtaaaatcgttgaagacgtatccgctgacgcagaagtattagacgtcactgataaaattgtaatgcctgctggtgtagaccctcacgctcacgttgcaggaccaaaattggttgtaggtagattatacagaccagaagatgaaagaagaggagtagctcaaaaaaccaaaacaaccagagcagaggctggtttctctatcccaagttgtcctaccactggatacagatactcaagaatgggatacggtaccgtttgtgaagcagctatgcctcctttagaagcaaaacacacacacgaagaaattaacactattcctaacattgacattaacccattgccactctttggtaacaactggtttgtaatggaatatgctagagaaaacagaattgacgatttggcagcattcattgcagcaatgttaagagtatctaaaggatacggtgtaaaaatcgtaaacccatgtggttcagaagcgtggggatggggtatgaacgtacacggatacgatgataaggctccatactttgacgtaacctccagagaagttgtaagagctttagcaaaagcaaacgaaaaattaggacttccacactctatacacatccaccctaacgatttaggtcaccctggaaacgttcctactaccattgcaactttagactcaatcaaagacattgcaaaatcaactaaaccatctgcttccgtaagagatcaaaccatccactgtactcacttacagttccactcctacacaggaaacagctggaaggatgcagcatctggtgctgaagaatgtgctgacttcattaacaagaacccatatgtaacttgtgacgtaggtcaagtaaccttcgacgaaaccactacaatgactgcagacgctcctatggaatacgacttgtttaagatttctggattaaaatgggctaacaagg

SEQ ID NO: 732 - DNA, 867 bp, Methanobrevibacter ruminantium
atgaaaactattacttttgatcaaaagaaaacttcttcaattgctttagaatttgatgagttaatcactgataacatttacgcttggaccgaagaggactttgcagaatacaaagttcctataggaaactccagattcccaatcactgattactttgacatcaccgttgaaggagaagcagaatctcctgctgaagtcaaaatgattttaaacggagattgtaacagagtaaaatacatcggctgtaaaatgagcgctggtgaagtagttgttaacggtgacgctgaccttcacgtaggtgcagaaatgtctggcggaattgttaccgtattcggtaatgtagcagctcacgccggtcgtgaaatgaaaggtggaaaactcgaaattatgggtaataccaaagaattctgtggtgcatcctatatcggtgaatggagaggtatgtccggtggagaaatcatcatccacggaaacgctggaaaacaatgtggtgaatgtttagtcggtggtaagatccacgttttaggtgactgtgatattctcgcaggtattcacatgactaaaggtaccattgaaatcgatggtaatgttaaccgttggcctggcggtcagatgaaaaacggtaacatagtcatccacggtaaagtaggaagattacttgaaggtttcgtagaacaaggaatcgtcacagaccctgaattagatggagtcacttatcctggcagatacatcgaatacaaaggggacattgctttaaacggtaaaggtaccttattaatcgatgctgagaaaaacagagacagattatctacctggattgaagaagacgacgaatataacgcaattagagaatacagagaccaataa

SEQ ID NO: 733 - DNA, 957 bp, Methanobrevibacter ruminantium
atgaaatttggtatagaattcgtacctcaaataccattagatgaactcgtaagattagtaaaaatagcagaagacgtcggttttgaatacgcatggatcactgaccactacaacaacaaaaacgtatacgaaaccttagcattaattgcagcaaacactgaaaccattaaaatgggtcctggtgtaaccaacccatacgtaagaagtcctgcaatttccgcttccgcaattgctactattgacgaaatctctaacggtagagcaactttcggtattggtcctggtgacaaagcaacctttgacgcattaggtattgcatgggaaaaacctgtatccacaattaaagcagcaatcgcagacattaccaccttattagacggtggaaaaaccgaagctggagcagctttaggtggagctaaaaaagtacaagacgcaatccctatttacatgggtgcacaaggtccaaaaatgttagaaactgctggtgaaatcgctgacggtgtattaattaacgcttccaaccctaaagattatgaagctgctatgcctatgattaaaaaaggaattggcgaccaagataaagatttcgatgtagctgcatacactgctacttccattggtactgactctgaagctgctaaaaacgcagctaaaatcgtagttgcatttattgcagcaggttcaccacctccagtaattgcaagacacggattaccagaaggattcaacgaacaaatgggtgaattcttagcacaaggtaacttcggtggagctattggtgcagtaactcctgaagctcttgacgctttctccgtttgtggtactcctgatgagttcatacctaagattgaagcattagctgacatgggtgtaactcaatacgtagcaggatctcctgtaggtaaaaacgtagaagaatctattaaattattaggagacgtaattgctagcttctaa

SEQ ID NO: 734 - DNA, 1017 bp, Methanobrevibacter ruminantium
atgaaagtagcaattttaggtgctggctgttacagaactcacgcagctagtggaattacaaatttttctagagcttgtgaagtagcagacgcaaccggtaaagaaaacatttcaatgacccactctaccattgaaatgggtgcagaacttttagaattagcaggtgtagacgaagttgtagtagctgaccctgtatttgacggcgaattcactgtagtagaagactttgactatgcagaagtaatcgcagctcacaaagctggaaaccctgaagatgtaatgcctgcaatcagagcaaaagtaggagaattagctgaaaccgtacctaaaccagctaacggtgctatccacttcactcaccctgaagacttaggaatgaaatgtactactgacgaccgtgaagcagtagctgacgctgactggatcatgacctggttaccagaaggaggtatgcaacctgctatcatcgaaaaattcgctgatgtaattaaagacggtgcaatcgtaacctccgcatgtaccatcccaactcctggattaaaccaaatctttgaagacttaggcaaaaacgtaaacgtagcttcctaccacccaggtgcagtacctgaaatgaaaggtcaagtttacattgcagaaggatttgctgaccaagcagctatcgacaccttaaaagacttaggtgcaaaagcaagaggttccgcattcaccttacctgcaaacatggtaggtcctgtatgtgatatgtgttccgcagtaactgcaattacctacgctggtcttttatcctacagagacactgtaactcaaatcttaggtgcaccagcaggattcgctcaaatgatggctaacgaagcattaaccaacgtaaccaaattaatggctgatgaaggcattgacaaaatggatgatgctttaaaccctggcgcattattaggtactgctgactcaatgaacttcggtccattatctgaaattgtacctactatcttagaatctttagaaaaaagatccaaatag

SEQ ID NO: 735 - DNA, 582 bp, Methanobrevibacter ruminantium
atggcggataaaaaacctactgcagaaaactggcctgttgtaagtggagattatattgtaggagatccagaaagccctgttgctgtaaccacattggcttctcacaatgaagacattcctgcagctgctggcgcagccattgctggaccttgcaagactgaaaaccttggaattgaaaaggttgttgcaaacatcatttcaaaccctaacataagatttttgattttatgtggtgctgaagtgcaaggacacattacaggtcaaagttttaaggcattatatgaaaacggctgtgaccctgagaaaaagaaaatcactggagctactggagctattccttttgtagaaaacattccaatggaaggtgttgaacgattccaacaacaattggaacttgttgatatgattgacaacgaagacggtggagcaatcactgcaaaagttaaggaatgcatagaaaaagatcctggtgcttttgaagaggattctttagtgattaagattgatgaagaaagatattctaaaaaaagcagttttgtggaatcttcatctgaaagtgaaaaaatagaatccgaagcataa

SEQ ID NO: 736 - DNA, 966 bp, Methanobrevibacter ruminantium
atggttagtgtcaatttagaagctaaaaaaactgtagatgtaatgattgaaaaggctgacgatcttaacattgctgtttccaaattagaaaacggcgcaactgtcattgactgtggtgtaaatgtcgcaggtagtttcaaagcaggtgaattatatactaaagtatgtcttggaggattagctgatgtaggcatttccattcctggagacttatctgaaaaattcgcattgccttctgtaaaaataaaaacagacttcccagctatttccaccttaggtgcacaaaaagcaggttggtccgtcagtgtaggagacttctttgcattaggttccggtccagctagagcattatccttaaaaccagctgaaacctatgaagaaattgattacaaagatgaagctgatcttgcaattctaactttagaagctgacgtattgcctggtgaagatgtagctcaatacattgcagatgaatgtggcgtagatgttgcaaacgtattcttgcttgtagctcctaccgcttccttagttggatccattcaaattgcaggaagagtcgttgaaaacggtacctacaaaatgttagaattcttaaagttcgatgttaaaaaggttgtacatgcagcaggtattgcaccaatcgctcctatcgacccagacggattaaaggctatgggtaaaaccaacgatgcagtgctctttggcggaagaacttactattatgtcaaatcagaagaaggagatgacattgcagcagttgcagctcaattaccatcctcagcagctgacggatacggcaaaccattctttgacgtatttaaagatgcaggatttgacttctaccaaatcgacaaaggaatgtttgcaccagctgaagttgttatcaacgatttaaccactggtaaattatacaaagaaggtttcgttaacgctgaattgcttaaaaaatcctttggtatagaataa

SEQ ID NO: 737 - DNA, 726 bp, Methanobrevibacter ruminantium
atggtccttgccttaagcataatcctactcagttcaattgcagcagcatctgcagaggattattctttaaccaatgccaaaatagatatggtaatccaggatgacggattagtctttgtggatgaggcaatcacctaccatttttataagaccatgaatggcgtctataggtacattccaatcaataactttaacatggaagattttgctgtagacgttgatggcgcatattatgaactggagggtaatgatgacgactctcaaatagaggctaaggtctatctctataaggataaggataaaaccgaaaagatcgaccctggtacagatgttacagtccattataagtactacatgagcgatctccttgatgtaaagggagacaatgcagtattgaactattatctattgggagaagattgggaggttgacttagaggagattgaagcaaacgtccatttccctgaaaagaaggagcttgattacgagcttgttccaagcggcagtgctgaaggcaagtggtctggagacacattgaccattactggagagaatattaatgctggagatggtcttgcattaatcgttgaaatcccattagatgagttcgcttcaggcttttcaaatgctgtccacaatgacactgatgatgatgatgacatagataatgatatcgataatgataaggatgatttaaaggacttgacaaaggctaagcagatttaa

SEQ ID NO: 738 - DNA, 561 bp, Methanobrevibacter ruminantium
atgagtacttttattttagtcataataatacttggtattattttaataatcgcaggaataatcgtagctctctataatggccttgtgactgcaagaaacaaggtaaagaatgcatgggctcaaattgatgtccaattaaacagaagagcagatttaattcctaacttagtagaaactgtaaaaggctatgccggtcatgaaaaatctgtatttgaagatgtcactgctgcaagggcaggattgatgaatgcaaacggagttaaggaaatcggtgaagctaacaaccaattaacaaacaccttaaagaccttatttgcagttgctgaaaactatcctgagcttaaagccaatgaaaacttcaaggaattgcaagctcaattagctgaaagcgaagacaagattgcatattcaagacagttctataatgacactgtattgatgtacaataacaaatgccaaaccttcccaagcaatttgattgcaggcctcttcggattcaaggaagctgacttctttgaagctgcaggtgaagctagatctgtacctaaagtcgaattctaa

SEQ ID NO: 739 - DNA, 507 bp, Methanobrevibacter ruminantium
atggataataaaaaaatatttgttattgtagctttggctcttttagctatcgttgcagtaggatctgttagcgctcttgatttaggtttccttggaggaaatgacgatcaagacactgctgctgaagatagcgatgccaagacaactactattaaaggaattgaatttaacattccagacggatatgttaaagcagaaaattacaccttagatggtgaaacaagatcaagcggaagtatagactataaggtatatcaagaaggttatgaaaaaggcgctaccgatgcaatccttttcttaattggagattatccaactgacttaactgacgatatgcttgaacaaatgaatttaggtgaaccaaagaccattaacggtcatgacggttacataaccacttccaacgaaggcggagacacattcactgtattcttctatgcagaagatggtgacttagtcactgttactgtaacagacgacacccttcttgaagaaattattaaatag

SEQ ID NO: 740 - DNA, 465 bp, Methanobrevibacter ruminantium
atgaacaataaaaaaatatttgccattgcagctttagccattatagctatcgtagcagtaggatcagtcagtgcttttgatttaaatttctttggaggagatgacaagcaaaccactactcttggaggaattgaattcaatatcccagagggatatgaaatagtagataactacactatagtaaatgaaactctacatgatggtgatgatgaatacattgtaaacagccagtattatgaaaacgatgatggggattcactagagctctatacttcagattatcaggatgatatggaagactatattttaaaaatactgactaaaggggatgaaaaaaccattaacggtcgaaaaggttatataaattctgaagacggatttacaatgttcagttttgtggatgatggtaatttaggttttgttactgtttcagatgaaagcatacttgaggaggtagttaaataa

SEQ ID NO: 741 - DNA, 468 bp, Methanobrevibacter ruminantium
atgaatgctaaaaaactaactattctagcagccttagctattctcgctatcgttgcagtaggctcagtaagtgcttttgacttaaatttccttggaggagacgacagctcaaccactactgtaggaggaattgaattcaatatcccagagggatatgagataaatgatacatacactatagaaaatcaaactagaaccagcagcggaggcaatgaatacattgtaaatcaggaaggctatggaaactccgacggtgaggaactattgttcttagttggacattatgatactgatatcaccaatgaaatgctttccgcaatgaaagttggtgatgaaaaaaccattaacggccaagaaggttttataacttccgatgatgtatacactgtattctcttttgctaaagatggtgaattggttacagtaaccgtttcagatgaaagtgcccttgaaagcataatcaaatag

SEQ ID NO: 742 - DNA, 1024 bp, Methanobrevibacter ruminantium
atgatttgctgtgttttattaacattttcaactgttagtgcaattgatatggatggaaatctaactgcttcagttaatcatttagatggctcccattcagatcagtctgcatttatttcacagtctgaatcttcgaaaacaaatttaaatgcaaataataatttaagagtttctagtggagattatgattgtgtagaaactatgaatgaattgtctaatttagattcaaaggattctaaagataataacttatccaaggataaaacatctttaaaatctgatctaaattctattgattcagatgagtattctcttaaatctagtcttagttctattaattctagtaagaaatcttcttatgaagatggagataatgaatatgagaacttggaggattctttagattcaaagaataaaaattctttaagttccaatgctctaggagcaggcacaagtacatttggcgatttgcaaaccatgataaacaatgcccaagagggttcaacaatcaatcttgatggaaagacatttatcggaaacggctcatttataaccataaagaaggccatcaccataaacggtggctctgctacaaacttggcacgattcgatgcaagaaacttatcatatatatttaagataagcgcatccaacgtccatataaagaactgttatttctcatacagtaccaactgttccgtatatttctttggaaatggatcctcaatagataattgccatttcgactacaattataagcacctgtgggttgctgtaaacatcaagtacttctcacttacaaactgcaatttcacaaatggaaagacagatatgggaagtaccgcatatgtggtagcagacaatgccactgtgaaaaactgcaatttcatcaacaatgaagcaagcggaaccgaacaatgttacggtgctgcattgcagataggggcttcatcctcaggcataaatgaaggatatgtggtaaattgcaccttcataaacaatagggttatcaccacccatagct

SEQ ID NO: 743 - DNA, 318 bp, Methanobrevibacter ruminantium
atgattattgccataatcttcatgtataatagggtccgcaataagagatcaactcctgcaacctttgcattatgggtggttgtttggatggtggtcttattctttgctttcgcccctaaaataagtgatcccctagcaggattcttcggattcagcagaggactggatctattgattatagcaggatttgcagtaatcgcatatgctggatttagattttatattaaaatcgacaatctaaatcagaatatgactgatttggttagggaaattgctataagaaatgaaatacaattggatgaagaaaatgatgaatag

SEQ ID NO: 744 - DNA, 1024 bp, Methanobrevibacter ruminantium
atgaataaggttcaattgtcctccatacttgctttagtattaatattattcttgtctttggctgtagttagtgcaaatgatgatattttaaatattaatgtcactgacacccaagatagtgtaattgataattcaaatggcatatcggattatttctcaagtgacaatggcatcattaatgatgatgggttaagctctgatgatgaaactgcaggttctcaactcttaaacgactcagaggatttggattcatcagatgatttagcaaaggatagtgatttggaagattctaaagagacatctaaaactcaggataattcacaaaagaatgaagattctaaaactagattatcagacagttccataataagaataacagattcttcatattcaagctactttgacctatccaaggatggggccattagggaaggaaccatcaaggatggagacactcttctcattggaaatgtctctggaaagatattctcaatcacaaagaatattaacattctccctatctcagatggggacacaatgtccaattgtctcatacgccttatagagggaagctccggtacaagtctttccaatttaaggattgtaaacagaaatgagaaagtcgggtccttctacctatgcgggattcatataatcaattctgcaggtcatgatatagtcaatctgacaataaacaacagccagatgaagtgttatggtataataatgtcaaacgcttcaaataacaggattatcaacagcacaatcatcacaggccaggcaacagccataccaatgacaggctcttccaacaatctcttctatggaaactacatagagacatacaataccaatatgatctactattgtatgtacggaaacggtgatttctatccaagggaggatctggaaaagtcccatgataatattatagcaaacaattatttcactagtcgaaacggtacatatgattcctactgctattcggtctgtctcatggcagaggcgggaggatcaggtacgg

SEQ ID NO: 745 - DNA, 858 bp, Methanobrevibacter ruminantium
atgagaaaagaaataatttctatattggtaattgctattatagcaatctcagttattccaactgccttttcagcaactgacaatggtattgtaataacttacggcgaaactacatacaataatcaaaattacaagtctattgtggataattactttgcaagcaagggatatggaagttccaacgttcaaggtgaagtgattactgcagctgacgtaaatgcaatatcctctggaataagcggaaaaacatacaattccaatcagatagtgtcatgcgctttggtggatatgacccaaaacaatgagatcacagttgaagtggacaattccattacaacaatcactcctcaaatgtatgcctctgccttaaagtcagcgggaattacaagcggacatgtctatgtaagcactcctgtaactgctactggggaatctgcccttgcaggaatcatgaactgttatgaggaagttacagatgttgaaattccagaaaatgtaaagcaagcagctaacgatcaaatttatacagaagctgcaattgttgaaaataatgatgatgtaagctctgaagaattatccaaattggtggatgatgtaaaggaagaggttcaggaaaagaatattacagatcatgatacaattgtgacaataataaatgactacagcacaacctataatatcaacatttccgatagcgacattgaaaaccttgcagataccattcaacagctccaagaggttcaagatgatgcaaacagctataaggaacaattggatgatgctgttaacaataccacatcaggattctccattgatggtattctcaatgctatattaagtatttttaatttcagttaa

SEQ ID NO: 746 - DNA, 411 bp, Methanobrevibacter ruminantium
atgaataaaaaaagatttaaattattattaactatttttatagcatttgcactcattaacacttgttttattttaaatgataatctctcagcagcagacaatgctccaaagggatatagcaactactatattcgtggggtctgcttcaatgtccctgactcatataaactggtggatgagggatgggatgatgtaaataggctaagctacgctcattttaaaaagggaaacaatttccttaatatcagcttggataagcattccacaaagtttaacaagaaccttttggatggattcagttcctttacaataaatggaatcaatctgaataagaaaaccatatctcatgtaactggattctatgcaaagaagaatggcgtaaaagcattttgtctttgcaacagaggatga

SEQ ID NO: 747 - DNA, 393 bp, Methanobrevibacter ruminantium
atgatggtcattctactaataacactcctttctgttcctatcctctcactaacaattgattattcaaatgatgtcataaactctataagcacaaagaatgaactgtcaaaaataactgattctattgatttctgctactatagcggaaagggttctaaaaaggtggtcttgcttgatttcaatcaagatttttctgttcgatttaccaacaatggccaaaaggggattgcatatgctgatttggaattgtcagataataaccacaaagagatatctagcgaatatgattatataggtctaaatacaaatattcagttttcaaagggtttcaataagattttagttgaatgggatgaggataccggactaatcaggctctctaagttaaattaa

SEQ ID NO: 748 - DNA, 1024 bp, Methanobrevibacter ruminantium
ttgatatctttatcaagcgtttcagctataaatacaaatgattcatctattcaagataatggagatttatccattcaagactcaattgatgaaatttcccaatttgatgaatcagaacaattaaataaaatcaataaggattcaccagaatccaattttaatcaagaattatctaatgattctaaagacatatctgcagattccaatcaagacctaatgggatttgagaattatgatttcaaatacaatacaaagagctcttattcaaatgccctaaaggactcaaatgtcataaatgttacaggaagcacatttcaagatattcaagatgctatagatagggcaaatgatggggacatcctttatctcaagtcatacaaattccatgggaatgggaccgccatcagcatcaataagccccttacaatcataggtagctatgaagccaataacaaaagccattatttagatgcatacttaaagtccagaatattatatatagattcagacgatgtcacattaatcaatattcactttgactatgggggaaatattgacaataatggcaatggaggggccatatatttggatggaacaaactgcgcaattgtaaattgctcctttaaggggaatcatgcttggctggggggagccattttccaatcaaacaattccaatgacctttatgtgggtggctgcaaatttgtagagaacaatgcccaaattggggcgggaattaccacatgcggattcaattgccttgtttcaaattgcagctttgaaaacaatagcgccgttaccgccggtgcaataatgacagacactcagaagaatggggatatgactttcttccgcttggaaaattccactttcataaataacaatgccacagggggaggcggggccatcaattttgacggctactaccaaagcgtctataattgcaagttcatagataactatgccaaaaattctgggggcgccatctatggcagtttaaaaccatttgacgtttccctatgcc

SEQ ID NO: 749 - DNA, 1024 bp, Methanobrevibacter ruminantium
ttggtatctttatcaagcgtttcagctgcaagtgatttaattcaagactatgaagatttaactattcaaaattcatatgatgatttaatcattcaagactcttttaatgaagatttaattcaagattcttctaatacagagttaaaaactcaagattcatctattgacaatctaaaagagactataaatcaaacagaatcaatagatgacacattaactaatcaagatttatcaagtctccaagactcttcaaaggagaatataaaggattccaatttaaaaagctcaagactgggaaaatccataaccgttaagggaaatacatttcaatccattcaatcagcgattgatggtgcagaagctggagacactattattctaagcgaaaatatgtttaagggagataattattatggccttggagaacaaatttatattaataagtcccttaccataatgggcagttctcaattcggcagccaatatataattttaaatgcactacatagttcccgtattttcaatatcactgcagataatgttacaataagcaatattcaatttaccaatggctacgtagtaggtgaacccggaggagctatttactggtttggaaacaatgggaaaattataaattcttacttctcattaaattgcgccaattcctctatggaatgggatattgaaggaggtgcaatttactttgggttgaaattcaaaaatcaatatattgaaaattgtttattcaaatataattctgcatatgatggcggagcattatatacctgttcgcaaaataccacaatctcaaaatgtacttttgacagtaattttggtatttcgaataatgctggtggcatggccaatggtgcagctctcagttttagtgctaaagatgtttatgtaattgattccactttcttaaataatgatgctccagaaggatggggtggtgcagtatatatctataaacatgggtatgaaccttatttctttaattgttcctttaaaaataattctgcag

SEQ ID NO: 750 - DNA, 1024 bp, Methanobrevibacter ruminantium
atgaatattaatttaaaaaaaatcacattcttatgtttggttttagttctaatcggtttgatctcatttaattcaatcagcgctaatgatttaggcactgtattggaggataatgataataacggattaaatgacttaaataatgatgattttataaattcagatgtgaattcagatagtataaataaagaagcaatttctaatttaaaaagtttaaatagtcaggatgaatctacatcttctgattctaataattctgctagttctaattctaatagttccgttgcttctagttctaatagttctgcaagttctaattctgctaattctaatagttctactagttctaattctgctaattctaatagttctgtaagttctaattctactaattctaatagttctgcaagttctaattctactaattctaatagttctgcaagttctaattctactaattctaatgctaacaccaataactccagttcagatgcatctaaaactcaaactataaaattatcctctcaagaggaaagtgcccttaatgagttcttaaatgcaatcaaaacaactactaaaggcacaattgttctaaaaaacgatttggtccttaatcaaactatctcacttaataacaatattacaatagatggtaggaatcattccataagctccttagatgttacaaacatgtttaagacctttgcaaagatcacacttaaaaacattgtctttacaaactatcatgaaatagagaatttaagggcaatacttaactctggagaattgactgtcctcaattgccaattcaatggattttcatatcttacaaacggctcagctatctataacagcaaaaagcttaccgttcaagggactaagtttaataacaattatgtcaataacagcggaggggccatctatagcacaggaaccctgactataaacaattcctcattcaacaaaaatcatgcaggcaaaaatggtggagccatctattccactttaaacctaatcctaaacc

SEQ ID NO: 751 - DNA, 732 bp, Methanobrevibacter ruminantium
atgaataatcaaaataagtattcttgcatagttttagctggaggcatgagcagaagaatgggtcaggataagggatctatgattatttacaataaacctatgattttacacatacttgaaaggctaaaccataagataaatgatgctgtaattgttttaaataatgcagaaaggatttcaatttatagaaatcttctaaatcaatatgcagacaatgatatagaagaaaattttgattatgaattgagcttcattgaggatgaggtcaagtcaaaaggccctatttcaggggtcatgactggattaaagaatataaaaacagattatgcactagtattgccttgcgactctccatttataagtggagaatatatagaaagcatgtttgggattcttgatgaaaatcctttagcagatgccataatcccttttcatattaagtcaaataaggataagttcaaggacaatgaggagtttaactttaaaaatgcagatgaaatgtctttagagatgaagatacagaattcagagcctttgcattcaatttataaaaaggacaatctgaataatataaaatctcttttagatgatgacagcttgtatgtgaaatcttttatcaggtctttaaaaagccctgtttttattgaagtggataataaggttttatttgatgatgactttaaaaatctaaataaacaagaggatattgataatttaaagtttaaaaaatag

SEQ ID NO: 752 - DNA, 1024 bp, Methanobrevibacter ruminantium
atgggttttttcgataagttgaaaaatgcacttgaatcaggaaataaatctcatgataagagggaatctcaaaagaatgaagcgatttcagataatccaagaggagattctctttcagataataaaaataggaattctcttccagataatcaaaatagaaattcttcagataacaataatgttcgaaatttcaaatatctggatgatctaatccatagcggccaaaaggatattgttctggattgcgatattgttctagctgatagtgaaattgaatcttacaaaagaggaatagatatcggcgggagtaatataacccttgatgggaatggacatgtggtggatggaagaaataaggcggaaatatttaaggtttcatctaaaaaccttgccattaaaaatcttagaattgaaaatggatatagtgagcttgattcaatcatagatgtgttttcaaaaggcgagttgcatttatccaattgcagcttttttaaaaattccaatgagtcccataggatatttggcgataatctggtttgtataggaagcataatacgaaatatgggggagctgaccattcaccattgccatataagaaacaactcttccaggggacagggaggaaccattaaaaatactggaacccttaatatatccgattcaatttttgaatataatctctctttagaggacgggggagcaatctttaatgaaggtttgctcaagctttcagactcaagatttgaattcaatcactccaataaacggggaggtgcaatccacaatgaattcaatggagagacaattattgaaaatagctcctttgataaaaatggaggccgcaaatcagctaatgacatttcaaacagattcaatcttgttttaaaggatatgcattcagatttgaaaatagataatgaatggactgtttttattgaaaagggaaaatcctttgatattgataataagggaggtataatcgaatttgctccattaaataatgatgagaaaagttttactttcc

SEQ ID NO: 753 - DNA, 735 bp, Methanobrevibacter ruminantium
gtggaagttgaaggggataaaatgaatttcaaggaatttgaagaattaataaatagcggagtaaaggagatttctctaaatgaagatataagtttggaggataagacacaagcgcctattgaaatcaagacagatggcttggtcattgatggaaaaaaccatatcatcgatggaaataacaagcttccaatattatatataaaagcctctaatatcactttaaaaaacatcatatttaaaaacggattctcagaggactatagcggtgccataactaactattccaatgacttaaaggtagagcactgccaattcatagataactctacagaaaatgcaggtgacttgtatgggggagccatctacaatggagaaaactctaaattgactgtggaaaagtccatatttaaggaaaatgattcagactttggaggggccatttttattgattcagattcaacagtaaagataaataattctgtatttgagctcaacatctctgaattcgatggaggagccatttacaataagggagaattgatcatagacaaatccatattcaatcagaacatggcctttaagggaggagccatctttaatgaaaacagtttgactataaatgattctcattttaaaaacaataaagcaagcgatggaaatgacatacagacagaaaatgaggatatttccatatcaaactctctttgtgagtttataaataatgataactattga

SEQ ID NO: 754 - DNA, 1024 bp, Methanobrevibacter ruminantium
atgaattttacggaatttgaagaattattgggcggcgaagcaaaggagatctctctttatgaggatgtcattttagaaagtgatgaagattacagaagaggcattgaactcaagagagatggcttagtcattgacggcaagggacatgtcattgatgcaatggaaagggcaaaggcattccatattcaaggagataatataactataaaaaaccttaagtttaaaaatgccgtttctcataagggcaatgggggaggagccattgagaatgtgggaaaagaattatccataaaaaattctcattttttcaataattgttcactgggtcctcttggcggcggagctatttgcagctttgaagatatgaatataaatgattgcatatttgaatctaacacttcagtaagatctgatggcggtgcaatatatttggagactttttttaagcctaatgtaactgtcataatgaaaaattgcagctttaaaaataattatgcagatggcgggtttaaggattttggctctaatgccggtgcaatatttaataaaaacgctaatttatatttatttgattgcaattttgaagataatggggtggtgagcgcttatgattcaagcagtgaatcgattcaaaataaaaatggcattataaccatggacaattgctgctttaataccagagagtcccattccatattcaatcttggatttttgttaatcaatagttccagattttatcatcatccggaaaatcttgaaattcaaggttcgattttcaatcgaggctttgtaggattattatatggggaaagaaaccaatataaagtggaattagatggaaaggtactggatagctcagatattggtgatttaatcaatgagtataagaagacatacaatctcgatacaaaagaagttggcttcatctttaaaaagaatattattgaatccattaatgatttaagttcggataactttaatttagaggatttcaatttaggcgatattaatttatctgactata

SEQ ID NO: 755 - DNA, 411 bp, Methanobrevibacter ruminantium
atgttatattatcgtggagcaggatgggccgattgggatttggataattttggaagcagaatatcatatattgacgattttccatttaatatcttgaaggctctcttaagctattttgaaacaggtgatgaacagtctgtcgaattcaatgcagaaggatggttttatactttcaagttctcttccgatgtcagagttggtgagagagtgatatatgaaagcactattgattttgcaaatgattttatctgtgaaattgaggaaagaatgggcttatgggctttttttccatcccgaagaacaagtgatgaagactattatgaattggtggatttaatcgtcaaaatcaggacagaactattagataaggatctaataaataaatggattgatataatttcacaatcttaa

SEQ ID NO: 756 - DNA, 1024 bp, Methanobrevibacter ruminantium
atgggggattatatgaatacggattatcttaaggaatttgaagagttgaatcacactacagaaagcctatttgatttgggaatctctgggcttttaatcattttaaaggacggaacaaatctgaccagctggagtgagctaagcaatcctgatgatatcttatatctaagtgcagacttccggtgtaaggaaaattacactgaatttagtaattttaaaaatgcaaaggtgcttatcctacagaattatgtccgccccaattttggagtgggcagcttgtttttcaaagaggcagatctaattactaaactgtctacttggcattcattggtggctttctatggaataaactgggacatctccagcactgattctttaaagaatatgtttgccaattgcctttcattggaatatgcatattttgaggattgggacacttcccatattcgtaacttttggggaatgtttgttgcctgctgcagcttaaaggccatagatggaatggagaattgggacttgagctctgcagagaatatggaatccatgtttgagtcctgcatgtccttggaagacatttcattcctatctgactgggacatgtccaatgtggaaaacatctttgaaatgtttagggattgctatagcctaaaggatgcaagctgcttgaattggaaatttaagaatctaaaaaatggtgacaatctatttgccaactgcagaaagcttgaaagctttccaagctggtatgatgatgagttcatcaatcaattcggcatcagaaatcagctaaaccttattgatgacgattcatttttctataagattgcagggggattcgacccccaggacattttcatagcagtaggatatatcagggatgaagaatgcctgaaaagattgcttagagattcctctgtccatttttatgcaagaagggccgctcttttaaatccaaacttaaatgacacagagattttagaggaatttgcagatagcaaggattatgtggaaagggcctatgcaa

SEQ ID NO: 757 - DNA, 510 bp, Methanobrevibacter ruminantium
atggaagatagaaaagcaaaatttatcgtttatgtcgttgtatgcttacttgcttttatctgcagcagcacagtcttctctatgactggcggtctttctgattggattgtatcaaatgtaaacactaatgaggatgccaataacaatggctatatagacagcagcgaaggacaatattattctgactctgacggacaatattattccagttccgactcctatgacaattcaaatggaggctctggatttttagatgggctcttttcaagttcggacaattcagaatcaaactactattcaagctctgatgaagaacctgattttcttgcaaggctcataagggaattcataggtggcagttcaacaacagacagttattatgactcctctgattcaaactactactatgaggacacatcaaatggatatgatcttggaaatggattctcatatgatttaaatgaactctttacaaaaacagacaataagcttaatcagttgtttaattaa

SEQ ID NO: 758 - DNA, 969 bp, Methanobrevibacter ruminantium
atgaacatactaatcaatggaactggagctatcggaatagggcttggagcatctatgatttcacaaggtgcaaatgtatctttctttgcaagggaagagactgcaaatgcaataaggaaaaacggaattaaaagaacaggcatattcaatcactattcatttggtccagaatcatttaaagtctacacagattacaaggatattccagataatgagtttgactttgtccttgtatcaagcaaaacaatagctaatgacgatataagcagaaagctaaacgaacacaagtccatcttaaaagaggatgctaaaataatcatatttcaaaacggctttgcaaatgacgaaccatacttaagattctttccaaaggaacaggtctactgtgcaagagtcattacagggtttaaacgcccagaaagatacatcagcgaagtcactgtccatacagaacctatattgcttggttctcttcaaaaggatgatgacggcgagttcattgacagccgcccagtctcaatcatttcaaagatgatcaacgattcaggaattccatctgaaaccactgaagaactggataagttcctatgggctaaaatgctttataactgctcccttaatcctcttggtgccatattgaatgggaattatggaaaactgatggaaaatgaatattccgttaaaataatgaatgagcttattgatgaaatatttgaagtaatcaaggcatcaggatacagaaccaattgggacagcccagaggagtatagggaagtcttctattcaaagcttgttccagacacttataatcacaggtcttccacattacaagacatttccaaaaggcaaaagacagaaatcgatacattaaatggaaaggtcattgaacttggagagaaatatggtgttgatgtaagtgtgaataagacaatttataatattattaaaacaatagagtctgaattttaa

SEQ ID NO: 759 - DNA, 243 bp, Methanobrevibacter ruminantium
atgtctgatgttggtaaaactgtaataacaactattattactttagtaactactgcatttggtttagtcgcaggtttagcatggaacgatgcaattcaaaaattaatcgactctgtaatgggtcctggagacgcacttactggattatttacttatgctgttattgtaaccattcttgcagttgttgtaaccattatacttgctagaatagcagctaaaatgggcgtagaattagaagaataa

SEQ ID NO: 760 - DNA, 420 bp, Methanobrevibacter ruminantium
ttgaaatcagataaacgggctaaatttgccatattcttctcaattgcaatccttgccttgggactgagcaatattgcagctgtatggactggagacttgataagcggttcacttccggtaatcaatgaaacagataagttgattgccttggacaatgacaatttctctccagcaagtttgaatacagtttatgaagaaaaaaaggttgtagaagtagttaatgacacatctgatgcaaacgatactgattccactccgaacaatgcagattccaatacggaaagtgatgatacatcaaattcaaacaataataacaataatcaaaacagcaatggcaacggcaatcaaaatacaaatccaaataacaatgccgagcctagctctggaggatctgcaggtcagacagaaacagaggaatag

SEQ ID NO: 761 - DNA, 111 bp, Methanobrevibacter ruminantium
atgattaatggaataatggacaagcagaaggttataactgcctttggcataattctatttttggcagctgctttcagtccgtttgtagtcttgcctatcttaggagtttaa

SEQ ID NO: 762 - DNA, 132 bp, Methanobrevibacter ruminantium
atgtttaataagaagatggttttagccataagcttattagctgttatctttgcatctatgtgcatagtttcagcagatgactctggagagggaagctttaaggaattggctaaattagtgtccgggcgataa

SEQ ID NO: 763 - DNA, 1024 bp, Methanobrevibacter ruminantium
atgaaaacaaatcttaaaaaaacaacaatcatattggcactgctgatggccattttaattttatcgattggagccatctctgcaaatgatttaacatcagcagattcaaatgtagatatgaataatgatttaaacacaaatttggatagcaatgatataatcgccaattcaaacagcaattcaattgatgctgaaattgatgaagcaaactattcaaatcaaagagcagatgccaaggaaaagttaaaggaaagcaattcattaatagaaaacgaaaatactgaaggcaatacacaaatagaagatgaaaattcaagcccttcaaataaaacagatacatcaatatcaattgaaacaaacagcatagaaaggggatccgatttaacaatctatctaaaggacataaatggaactggaatagcaaatgaaaagctatcaatccaaataataaacaagacctacacaagaacaacagattcaaagggctctgccctttttaaaataaatcttgcatctggaaaatatcctatagcaatatcctacaatggcagcgaagattatgaatcatcatcagatgacttcaacataagcgtttcccctatgaaaacaaagatcaatatgctcagcaattccattgtaaacggaaggaaactaactatagaattgttggataagaacaacaatccattaaaatacaaaaagatctccattatcctaaataaaaagctatataatctcaccacaggcaaagatggaaaggttagcttaaacattaatctgaatcctggaaaatttcctatccaaataactttcagtggagatgcaaactatcatacagtatctaaaagctctgcgattgatgtatataaattaaaaagcagctttacagttccaaaaacatcaatcataaaaggaaaatacttatatgtctatttaaaagatagcgaaggcaaagcaatcccatccgcaaaggttgccttcaagatcaatggagtaagctccacaaaaacaacagacaagaacg

SEQ ID NO: 764 - DNA, 735 bp, Methanobrevibacter ruminantium
ttgtctattgttagtgcaaacgatttgaattcaattgacgattccattgaagcagataatctaaattctattgaaattgaagacattcaagttgattctgtagaatcagatgatttagaaaagtctaatattgatgaaaaagttttaagtgatggggaatcagatggcgattccggcaatgaaactgaaactctttcatcaggtgatgaaaataatgaatctgatgtctcttctaatccaaatgaaggtgtagctactaatttagaattggataacgatgctgataaggaaaatgtcaagattggcgagttggttacttggactctcgaagctaaaaattatggtccttatgatgctgaaaacactcaagtctatgacgaattgcctgaaggcttagagtatgtcagccatactgtcacaaagggagaatttaatcctgaaactggcatttggaaaatcggggacttgaaagtcggtgagaaagagtatttaaaaatcgttacaaaggcagttactacaggtgaaaaggttaataaggctaatttaacaagcgatacagatattatcgatccggatgaatgttacgaggaagaagaaattgatgtggaagatgatgatgacaatcattttgaaaaagttatacattcaaaacaattacctcgtgtaggaaatccgatatttttacttatcttgtctttattgacagttttaggtttaaatactagaaaaaaatag

SEQ ID NO: 765 - DNA, 756 bp, Methanobrevibacter ruminantium
atgaattccaagggaaaatatcttgttttatttcttattttaatattatcatttagcataatctctgcttcatttgcttatactggaactggattttctcatgacattccattttccaaatactcaagccagtcaaacagtgatatcctaaataaatacaataatacagattgccatagcgaaatcaaaggaatatgtacttatgtggcagatggggacaccatcgatgttgaaggtgttgggagagttcgttttgtaggtgtcaatactccagaacgtggcgtcacagcatatatctgctccaagcgttttgttcaaaagttctgtctgaataaggaagtcagcctggatgtagatgactctaagagaaacgatagatatggaagaacattggcggtggtcattgtagatggcaagaacctgaatgaaatgcttttaaaggaaggccttgctgagatcatgtacattcctccaagtgagttctatccatatgactggtcttcagactccactacaagctcatcctatacgtcaggcagcagctcttcaaatagcggagggtcctattcatcaagcagttttacaagcggttctacagtctctgctccttatgttggaagtgcaaacagtcataagttccattattccacttgcaaatggggaaagaagatctctgataagaatagggtgactttcaatagcaggtctgatgcgataagtcagggttatgctccttgtaaggcatgtcaaccttga

SEQ ID NO: 766 - DNA, 1024 bp, Methanobrevibacter ruminantium
atgaagaaaaatttaagcttaaaaaatattttaattttatcattaatcttcctttttgtattaagcataggatcttcatttgcaacagaagatttaaatacaacaggagataacaatctaatagatgataatgccatggcagacacattatctgatgaaaaagagataagctatcaaaagccattaatgtctgatgaaaactctaattcaaataatggatccgatgaggaaaaggttataagttccaataatagtaaatcagagagttttcttatcatacgtcctaacgaatcttctattacagtattaggaggtaattttcaagatttgcaagatgcaattgattatgcttcagataattatacaatatatctaatttgtaatatgttgggtgaaggaaaaccgattattgttaataagagtgtagtcattgaaggaaatggccatactttagacgctaactattcatctagaattttctgcattttgtctgataatgtagtattaaaaaatttagaacttattcatggctatcaaagagcttatgattcttataagttaaggccatatgatagtaaaaactttgataatgcccctgctttaactcaggagttctttgattatagtgtccctcctcttaattcaactgatgatattgaatatggttggggtcctgctattaaatggcttggaaacaatgggacattgattgactctgcaattttaaataataagattgattatgctaatgatattggggaaggtaaagccgtatcctggcttggaactggcggaagaataattaatacatttatggtgtctaatgagtatcatcatttttttgttccttggggaattgttggctatcagcaaaagtctgaaggaaaggttttagatacttctcctcatggggtttattatggcaatattgaaggaaatgtgtattttcttgatgtggccttaaatgttttgcctaatttggatgttaaaaatgtcacttcatattatggtgaaggcaaaaaga

SEQ ID NO: 767 - DNA, 1024 bp, Methanobrevibacter ruminantium
atgaaaaggaatatttattttattattttattagttacactatttttaatcagtatgagtgttgttagtgcagcaaatgatgctgatgtctcttatattgatgatgaaatagtttctgatgaatatttagaactttctgattctgaaatgggcatttcggatatagattatgatgatattgaatccgatatgcttgaaaatgaaatcaaggagaatggattgtcagataataatgatgttcttaaaagtaatttacctgaaaatgaatttaaggaatcaaattataatgagtattatgaggatataatgaattctaattcccaaaagtatggggaattcattaatttcttgattaacaataaatcatttgaatttagagaaaattccttaagtgaagacggttattttctttatgcaactaagaactatactcttcggttatgggatggtgtaaattacactattttaaaagatgattattattttgcttcaaccgctgaaaaatcaggctattttgtaaatgagagtttttacgatgatataatatattaccatgaatataactattatctggatgaagaattcttaggatggctgatgtggaacgctaactataaaaaagttttcgtgtcaggttcaatagaagataaagttgatatctcctcagtagtcaatcctgaaaagggaggatctcctaaaagtggcaatctaccaagttcttatgatttaagggattatggatttgtaactccagtgaaagatcagggaaatactgctaattgttgggcttttgccacaatggctgctttagagtcacatctcttaaaaactgaaaatacatcatataccctttcccctcaatgggatttctctgaaaataatttgaagaatgtgatgagttcccttggacgaaacggtacagataagttagtaaatagtggggggaatatgttaatgtctttagcatatcttattcgttggagtggccctataaatgaatcagatgatccatataattctaact

SEQ ID NO: 768 - DNA, 216 bp, Methanobrevibacter ruminantium
atgaaaaaaatggaaatggctagttatattatcttaattgcatctgtattagctatactttatgcattaatatttaatccagctgattggatagtctatgctatagctattgtatgcataccatttttagttctttcatttggtctattaaccatgtctaaaccaataaaagaagaagaggaggaaagaagagaagaaccatttacaggttattaa

SEQ ID NO: 769 - DNA, 600 bp, Methanobrevibacter ruminantium
atgcctaaaattgcaaaattatggaataagctagcagatccaaagaacattcctaggctgtttgctgtaattttaggtctgcttctcattgccggattcctaatccctatgggattgaatacagatcaaatctacactcgtccggcacctcaaagtcagatggatgcaggacttcctcttgcgccatacgataggggaggagaggttttagagtctccaggcataacagaagcccaatatcctgaaaatgcagagaatcttggctggataaactcatatatgactccaatagcagagatgctcaagggaatatccccatactttggaacaagtatctgttcatctccaggtggtcttattgatgaaatcctttattatacaagaggtttcgatacaatccttgaatcctccattctcatgatggcattcataatcgcttcatggcttgcaatcaactttacaatggataggacaaaggatgaaagggatattgctgaagatgtaaaaagagccattgccagttctgacagactagccaatgaggttgaagaaagcaatagaaaggctcgtgaaaaacaagccaaaaaggagtttaggtga

SEQ ID NO: 770 - DNA, 261 bp, Methanobrevibacter ruminantium
atgtttaatctggctatttgggtttatttaggtttggcattagctatttttggaagcctcgcaactgtatggggtcctggagtaaaggatccagttattagaacaataaacacagaagttgcatccgtaggagtttcattaattttactttgttataattctacattggctcttttgacattgattgcaactacaatcattgttaccttaatcttgtttagagctatttctcgcttagaagagataggggctgatgtataa

SEQ ID NO: 771 - DNA, 1024 bp, Methanobrevibacter ruminantium
ttgttcgctatagtaagcctatctgcagtcagcgcaagcgatgatttttcaagttcccttgctgatgactctgactctgatattcttgctattgacgatattgcacaaaaggacagttctcataaactgatggatgaagaggacattagtgttgaatttgaaattgatgatggggatgatgatactagctatgattcctactatgacgattctccaggtgatgactggtcaaactatgaggattacgaccctgaattaattagtgaagatgctatattaactaaaatagaagtcttgaatgtccctagccattatggtgatgacaacatttcatttagattaatcgatttgaatacaggccttccaatacctgatgttaatttaggccttcaggattcctatgattatgatgtctattcattcttcacagatgaggatggtgttgtagtatatcctatccctgttaaagttggagatttctctattgtcataggattttatgaggatatgatggttgttaatgaattggatgacatggtatgtaactttacaaaattaaatgtctcaattccaactgttccagcttcaataaagattacaaaaacaggcacttattataatgatacagtattaaaggtttctttggtcagttctgttaaggaagtcttatcaaatcaaaaaatcaatctcacattttcaaatggtaagaaagccacagtgaagactaattccaaaggaattgcaaactatgcccttaaatttgcacctggaaactattcagttacagcagctttggtttccgatggcattgttgaagccaataagtccagcttgaaaaacatcaagatcattaaggctccaggcacattaagccctactgcattgtcaaccacttatgcttctggaaagtatttccaaatcaaattgacaaattccaagacaaaaaaagccattggtggagttaagcttaacttgaaggtatatactggtaaaaagtataagacagttacagtaacaaccggat

SEQ ID NO: 772 - DNA, 1024 bp, Methanobrevibacter ruminantium
ttggaagagaatccaattgattttaaggataattcaatcaattctaaagccttaaaggatagcgattacgagcatgcctctgatgagttgtctcaagacttatacaatagaatcataaatgcaaaggaaaatgaaataatattaatcgagcctggaacctataagatacacaaggtccatcttacaaaaaacataactctgcaaggaactggcgacccaagagaagtgattatagacggtgagcaattaggaagtgtctttttcataaatgatataaatgtcacagctcaattttacaatttaactataataaatgggttatcagataattttggcggtggaatttgtattgaaaccggaaatacatatgttgataattgtatcttcataaataacactgctttgaatataaccaatggtggagctatctccaattatggaaatgaaaccaataggagttatttatttataaacaactcattatttattggaaaccatgcagatcatgatggaggtgccgttacaacatgctatgcaatttccgatatctataattctgtattcattaataattcagctgtaagggatggcggagcaatccgtgtaagcgtttatggctatgggaatgtccaggactgcatattcattggaaatcatgcagatgaatgggcaggtgcctattatagctgggctggaaattcaagcattgacagatgcatatttctaaacaacactgcaggaacaaatggcggtgctgtaatggtttccggaagccttaatcttaccaattccttaatcgtaaataacaccggaggcgaaacaggaggttccttctatattcagcagcctatgtttgatgcaaagacggtcataaatgtaaataacaacattattacaaataattcatctcctttaggaaaggaaatctttgtaaaatggaacgctacccaattattattccctaatttcaacaataacgattggggagacgaggaccctacaggccctgatgtggttgacccta

SEQ ID NO: 773 - DNA, 1024 bp, Methanobrevibacter ruminantium
atgaaaagaagatataaagttttatttctattggccatcttaactataataagcattaatgccatttcagctagcgaaattggcttagatgacaataatgcaatagatgagaatgatggatttaaaattaagcaagacataatgtctgaaaagataatctctgataatgaggatgcagattcaaataatgcaaatgatgtgaatacagactcatccgatgaagtaaatgaggataatgtaatagaacaaaatacagacactgatacagttgatgaggatgaagaagatccaatcattccagtagacactagattattcaatccagattctgttataaaaggaaacgatttaaacattgttctaaaagacatcgacaacaatcctcttgccaatcagacaatcaaatttaacataaatgacaaacagtaccaaagaactacggataaaactggaactgccaaattaaagattaacttaagcccaaagactcacactttctttatagagtatgacggatgcgatgaatactatccgaccaatttggtatttgacttaaaagtgataaagccagttcaaacaaaattaagcgtaaagtcaacaattgtgtataaaaacaataaattaatggtttatttaaaaaccagcgacaataaggcacttgcaaaccagaaaataaaaattggattgccgaaaaaaacatacacaagaacaactgacaagaacgggcttgcaagcttgaatataaatttaaatccaaaaacatacagcataaaccttagctatgacggcaaaggcaaatacctcccaacaagcaagaaaataaagattcatgtctttgaaaacgaattgcttggatccacatactatggaaaggtggaattgcttaagggaattggaaactcatcatcaaaggttaaaatagcttatgtggttggacttcatgttttggaacatcagatacacgatgaagtttacaatatcatgaagcagaagacttcaatgcattattcatataatgtctata

SEQ ID NO: 774 - DNA, 1024 bp, Methanobrevibacter ruminantium
atgctcttttcagtaattgctactgtatctgctacttgtaacgtaatcgttattactgatcctagtggagaagatcctaacggtgctgcagcaggaagtatgtcctttgcaaataacatgttccagtcttcattcatcatgtctaaagatgatggatacgccatgctttcagggggtgaaggtaatggtacagaaaggaactatgcgattattgcagcgcttgcagctatgcagcatggagccactccagcatctgctgccgctttggcaagtggatttaagggtatccgtcttgttattggaggcccttcaatgggtgcagctatcggtggagactataacgcttatcttgttgttgtcgacgatgccggaaccattaaggtcacccaccacacaggaggagttgttcaattgcctcaaggttccaaaggagctatcattcacttgagaaacagtgcaggtaaccctatgtatggtactgcagaaagagtccgaagagagactgcagttaatataggaaaaatgattagggatggttatcctgccacttatattgtcggtaaggccatgaaagaggttgccgaggattcaggtgaaaaatacggtgggggtgcagtaaaccttgtttccagtatcagtacgggagacatgtttgtgccggatcaggtaaacaccaccggttatccgatggatgagaactattccaaatcctgtgaaaaatgtggatgggctacaggttttccagatgctgagcgatataacgtttgcccatactgtggcagtgaactgacagtgaactctgctacagatgttctaattgactcaatcacagtttctaaagattctgtttctgtttccgtttatggaagtgatagattaggactctcagacattacaagagaggtcgtcaaggcgtcagttaagaaatatggttataatgcttcaaccattgcaggttcacttaacaaaggtattaacaatggtttaatcgttggtgttgactatgtagagccaagcgacttaa

SEQ ID NO: 775 - DNA, 498 bp, Methanobrevibacter ruminantium
atgtttattaaaattagaagagacactttaataatattattattggcttttattttaattctatgcggtagattaattatctatgtagcttatgcatcctctgctcaagtcgaagaaggcgtacctattgcaggtattatcgttaagggaaacgacatagttcctattgacaatataagatataatgttgaaaattcaggtttaagagaaggcagttatattgatggagacatccttaagacctctatacgggagctgcctgtgactgaagccgaggcaaatgcagagaagtttgtaaaaaggtcaacaattccaggtaccactatcgctccaattgcaggagctgacgttaatgtaaacaagcaaactggtatcgtaaccgttactgttattgaagatttctcaactattaatattacaggaaacagtaccacatctactgatttcacagaaaacgaaccatcaaaaagtgtttataattatagcttagcaggttag

SEQ ID NO: 776 - DNA, 846 bp, Methanobrevibacter ruminantium
atgaaagcagtcattcctgcagcagggcttggaacaagattccttcctgctactaaagctcaaccaaaagagatgttgccggtttatgacaagccgaccattcaatatgtaatagaagagtctgtaaattccggtgtagatgatattctaatcgtaactggtaagggtaaaagatcaattgaagaccattttgacaggtccttcgaattggaacaccatttgaaaaccaaaggaaaagaagatttcctaaaggaaattgaatatatttcagatttggcagatattcattttataagacagaaaaagcaaaaaggtcttggagatgctatatattgtgctaaaaagcatgtcggcaatgatccttttgttgtcatgttaggggataccattacaaaggatacagttccgtgcacaaagcaattgattgacatctatgaaaagtatgaaaaatctgttatcgcccttgaagaggttccggatgaaaaggttgaaagatatggtataataggcggtgaagagatagaggattcaatctataagattgataagttagtggaaaagccacctcttagagtagcaccaagtaatttggctattatgggaagatatgtccttacacctgacatttttgattgcattgaaaatgtggagcctggatacggtggagaaatccaattgactgatgccttaagcaagcttgatgagatttatggccaggtatttaagggagagtcatatgatattggaaaccgtattgattggctaaagacttccttaaggtttgcattggaagatgacagtgcaagagatgatatattggaattcattaaagaagagattatttaa

SEQ ID NO: 777 - DNA, 1024 bp, Methanobrevibacter ruminantium
atgaattgtagtgtatatgaagattatagtgaaaatattatcacagcagatctaaattcaaattctaatgagcttaattcagattttgcttatggtgattcagattctgaagaaatcttagatgaaccctctcaaaagcttaaaacaggttctgataattctgattttaaagacatacaaaatttaatcgataatgctaaggaaaatgatgtaattgagcttagcggaacctatacaggtgattctctaattgtagtaaacaaatcattaacattaaagtcttcttcaagtgcaacacttgatggagaatttctaaatgaattaatggctataaatgctccaaatgttatattggacaacatcaactttataaatgcaaattacactggtcttagtgtaaataacaattatgtaaccattcaaaattgtaattttgacggctgtatcaatggagagttaggatgtgccttaataatccatgggaataatgtaaatgtattaaactctaattttacaaataatgttgcaaataagtccagctgtcatcatacggatggggcagcaatttatcttattggaaacgattgccaaatcgataattgcagttttataaataattggggttataattttgaaacatcctcatcaggaggagccatttggataaagggaaataatattgtaattaacaattcatatttctttaataattcagctaccgctgaagttggatggacattccatggagaggagataacctatttggcagatggatatggcggagcagcctttttagttggaaaaaatgtaaaaataatcaattccctttttgatagtagcctttcccatgcacaagggggagcattgtattataagtctgcatatgattgttcaataatcaattcaacctttttaaattcattttctgttggagagggaggcgtaatctatttaggtcagaatattgatgggctaatgatagattcttgtaattttataaacaacactgcagacggattggatg

SEQ ID NO: 778 - DNA, 1024 bp, Methanobrevibacter ruminantium
atgattaaaactgatgtattggttattggtgctggacctgctggttcttcagctgctagatttgcagctaaaggcggcgtagatgttattcttatggataagaaatccgaaataggcgctcctaaaagatgtgctgaaggtgtatccaaaaagacttttgataagttagaccttgaaatggatcctcattgggttacccaagaaattgcaggggtcagattagtcgctcctgacggaactgatgtatggcttgatgaagatgttattgacttgcctgaagcaggatatatcctagagagaaaagtctttgataagcatatggctatggaagcaggaagagaaggagctcaaattaaaatcaaaacccaagctaaaggcttgaaaagagaagaagatggaagcttcactgtaacttgcgaatccatgggtgaaacctttgacattaatgctaaaataattatcggtgcagacggtcctgaaagccatgttgcaagatgggctggcttgaaggcatacaccaaacctaaacacatggaagctggagttcagtttgaaatgtgtaacgcaaaaatggaaaagagcaatgttcttgaattctactttggaagcgtagctcctggaggatacttctggcttttccctaaaggagatgacattgtaaatgcaggacttgctatcattccagatatggctggagataaatccgcttacgaatacttagttgatgctgtaaacaactgttatgctactaaagacgctcagcctgttgaattgaatgtagggggagaccctgtaggcgggcttgttaaggaaatgtacggcgacaatatcatgctttgtggagatgcagcaagccaagtaaacccattgactggtggaggaatcaccaatggtatgatgggcggaagatttgctggtgaagtggctgctgaagctattaaagcaggggactgctctaaagacttccttaaaaagtatgaagatttagttaaagaagaaatgggtcatgaaatgcaaaaataca

SEQ ID NO: 779 - DNA, 1024 bp, Methanobrevibacter ruminantium
ttgagttctaatagtttaagttctaatgaattaaattccaatcaattaaattccaatcaattaaattctaattctatttcaaattctaattctaattctaatcaaaaagccaattcaaaagattctcgtctgattttgctcaatgataaaaacttaaaagtaaacggaactgaagaaaaatattttataaagcttgttgatggcaacggaaatcctataccttatgttgatcttatttttaacatagattcttcaattgaattcgttggaggtaccgttcgaactgatgaaaatggaatcgcttatatttttatggatttctcatatcctggtccatatactgtttatgcttcatttgaaggtgatggaaatcataatccttccagcactttatcttctacagtatccgtttataaagacactgaaatcagctcattacagtcatatggctatcttggagagaacttttcatttaagattacaagttgcggggagcctgtatccaatcagaaggttcttataagcattgataataagaattatactgcaacaacagattcagagggtattgcaaaggtaaaactaccaaatcagcaaaagacctattcaatatcctgtaatttttcaaatcgtgtatattactatggatctagcttaagcaagaatattcctgtttataaaagggctttcacccagccaaattgctatgcccttttaagaaaatcaacattcacagttaccttaaagggagctgatggaaagattctatcaaatcgcaccctaagatttattgtggatggaaaggaatataataaaacaactaattccaaaggtgcagcttccataaatattgatttggaaaggggagaatatagaataaattattatttcaacaccgatggggtttatggtccagtaagcaattacactgatttgaatgttgtagatccttcaggccaatacaaaaggcttttgaatgtaaaaagctctgcttcagctaagatatatctcactggcggaggat

SEQ ID NO: 780 - DNA, 1024 bp, Methanobrevibacter ruminantium
atgggatttgtattaatatcctctgtatctgctattgatattgatgaagcaagttcttcaagtgacttatcagattctagcatttcaaatgattatttagtagcaaactctggagatgattctgtagctagttcaagtgcatctagttcaattgctgcagatgattcagatctttctaacaatgctagttcaagtaatgttaatttcgaaaatgaagttttaagtactaataataatgaagatacagaatccgaaattgtaaaggattctaaaaatcaattgtcttcatcttctcttcaagctagtactaaaactaaaaccactcttaaaggcagtggaagctccgtctataggggcaatccatattatgttactttaactgatagtaatggtaaggttttagctagtcagaaagtgacttttaacatccttggcaaaaattacactaggaccaccgattctaaaggtgtggcttccattaacattaatttagccaaaggaaagtataacatagcttgcttatatgcaggcactgaaaactatgcttcatcaaagctatctgtagctttgacagttaatttaatgtccactaaaatcaatacaggtggatcaaccgttaaaaaaggaaatgcttattcagtgaccttgactgatggaaatggaaaggcattatccagtcagaaggtgaccttaaatatccttggaaagaattataccagaaccaccgattctaaaggtgtggcttcaattgcaatcaatttggctgcaggtaagaaatttaccttgactgcatcctatgctggctctgcaaattatctctcttccaaggtatcagcaactgttactgttcaaaaaggagatacaagcataaagcctagcggaacttcaatcgttaagggaaatagctattcatttaccttggttgatggaagcggcaagggattggcaaaccaaaaggtcgccataaagatatcaggcaagtcctacagcagaaccacaaactcaaatggtgtggcttcaattg

SEQ ID NO: 781 - DNA, 1024 bp, Methanobrevibacter ruminantium
atggaggataatcttttgaaaaatagaaaactaattttgataagtatcttccttgttagtctgcttgcaatttctgctgtaagcgcaaatgaggatgtggataatggacttatcgattcagatgattctatcttgcagtcagctgaagtctctgattctgccattggatcagattctatcttgcagtcagctgaagtctctgattccactatagaatcagactctattgaactggaagataagggtaatgttttaaagtcaagtgataatgcttcttttgaactagatgataaaaataatataggatcagcagattctgaattggaagacgattatttagaacctaaagaaaagaatgttctttcaatggatgagaatgcatggttttataattatattgtgtggtatgatggtgatgatggagattgggtttcccttgattttgtagatgatttaaaaaatcctgaaaacatcaccatacgattaaacagttatgacactccatttgacggtgtggatttggctgttataaatgattatgactattcaatcactaaattaaccactgatgataatgggactgtagtttataatgttccatatgaggttgatgaattatctgtctttgtaggcttttggtatgatggggattttgtggccacttatggaaattgggaaagttacacaatctgcgcagtgaattggggcacttggtatagggacccttctaaacggacttacgacttttatgtctctgtgtctgatatggacacttatgaaagtccaattggcgcacaggtggtttttacaagcgattccaatcaatatgtcggaacaatagatgagaatgaaagagcaatcataccaaaggtcagctatggcacttatgatgtgaaggtcatatatgacggctattgcattcttaatctttcagattctagcgccattgagttctatgacgaccatcatacagaccctgattcacttggtgatgaaaggatagattatatgtatgtagatagta

SEQ ID NO: 782 - DNA, 438 bp, Methanobrevibacter ruminantium
atgaacagaaataaaataattgttttgcttgtattattgatagcagttgttggctttacaatggggccagcttgtgcagccagcactacaataaaagtaggcaattacaaggatgttggaaagggagataggatttcaacattcaatgtgcctaaggatgcacagtatttaaaaggagtttatgctgtaatattctatcacggcaagaatggtgacgatttcaggccacatacctatgtattgtctaagataaaggtatattataagaataaaaaaggcaaaatcgtaacaaggtcttctacagctaagaatctcagcggacttagcatactttccactaaacaggtaagtggttacactccttataagatggatgtaagttataggaagatgactaatgctgagaaaaagaaaatttgtggcagtttagtttattag

SEQ ID NO: 783 - DNA, 858 bp, Methanobrevibacter ruminantium
atgaaaaaatcagtttttaaaattctaattgctttagctttaattttattggctgtatcaattgtttcatctaatgatctctctgattctaatgtttcaagtgatttaactgttgattcagactctataagctctgatgatacaggatctagcgatacaagttcagatgattcaaatcaggatgatgtatctcaggataagactaatgataaaaaactgtctgattcccagtcagattcatcaaaagatactcaagatactgatgataataatacagataatggttctgataaatgtaatttgattatcacaaaaaagggcaatgagaaagtcaaagttggagatactgtagagtggacaatagaggtaaaaaactctttaaacactgcagaaaacatctctgttgatgagttcctccctcaaaactttgagtttaagtctgctaaggcaagcaaaggaaactatgcagttgagatagcaaattgggacattggaaatttaaaggaaaatgaatctgctaccttagtgattaaggctcaagcattaaaggctggaaatttcaccaatgtggcaaatctcactacagattccgataatatcaatggaaaggtccttagcgctaaggcagatgtggaagtgctttccgagaataaaaagaatgagactcctgtaggacctaagaagaacaaagataataattctacagtcaaaaagattcataaattaattaaaaatcagacaaataatacaaatatgactccaatagattttaagaaatctggaaattcattgtttgctgttataatagctgctttggctgttcttggaatatttttaggacgaagaagaataaattag

SEQ ID NO: 784 - DNA, 1024 bp, Methanobrevibacter ruminantium
gtggatttgtctgattcttgttgtgatactcttatttcagatggttctgatggtattattttaggtggatctgatgatattagtcttagcgatgaaaataataatttaaattttgatttaaatgataatccggattttaatttagattatgatagtaattcttatcctaatttaaatttatcttctaattcaaattccaagtccagttccaatacatatggtaatgattttactttatccagattcaaatccgttttaacttcttcatataacttgaatggaggcagctttgaagatattcaatctgccattaaccatgctgctgatggggatgatataatcctcaatggcacttttacaactactggctcagttattgtaataaataagacattaactatcattggaagtccaaatgctgttttggatgctaaaaacatatcaaagatttttcttgttgaagcagatggggtgaaccttaagaatctaactttcatcaatgggaaatcaaggaacgaaagtgataatgggccttatcaaggaacagttaactggcaggggagcaacggaactatcgttaattgcagttttattaacaatagcggtgatgagaaaagttatggcgcctctattctttggaaaggatcctatgggaaaataagcgattccatttttaaaaacagttattctggagctaatgggggagcaatatttgctttaggagaaaatttaaccatcaataattcagagttcatcaataaccatggaaaggaaggtggagcaatctatttcggaggttcttcagctatgtggattataaattccattttcattaacaactctgcagattctggtggcgcccttgcagcttgcgctatgaataggcaagtgattaactctaaattcattggcaactctgcaaataatggagggtccatttcatggtgcggttctaatggattgattagcaattccactttcattaataattcagctgatcaaaaaggaggatcaattttattta

SEQ ID NO: 785 - DNA, 510 bp, Methanobrevibacter ruminantium
atgaaaaagaatatttttttaattgcaataatactaattgcagttgttgcagttagtggatgtataaatagccctatggataatatcaataacaatatgaaggaattgaacactgatattaccgaaggagacaccgattataattctgctatcaattatatcaataataaggactttattagtggaactgacaacatccaaattgcaaaagacaaatttaatgatgctgatgagaagctttcaaatattgagcaatataaatctagcctaaacgagagcatttatcttgattatttatatttgattaaagaggaagtttccattaaaagacaagccagcgatgaactttatttggctttacaatattatacaaacaatgatttcagctctggaaattcatatgcccaatcagcaaattcattaatgaatcaggctaaagttttacaagatgaaagaaaccaaattgttgaaaacaatcctgatctatttaaaaaagcaggaataatctga

SEQ ID NO: 786 - DNA, 702 bp, Methanobrevibacter ruminantium
atgttgattgccttacttggcttatctgctgttgcagcagttgacgctgacccattaactgataatcaacttaatccaactattttttatcttgattttaatcatggcgctttaaatgatggttttaaaaaagaatttgatctctttgagtatgttccaacatttgatagcgtagacctttacaacgatggagaaaatgtctctgtaagcttttatagtttaaatcctaccattgatgtggataacttaaatgatgagattatagattatacatttgaggttatggaagatcctaaagccaatataactacattaaaggatggaataaggaacatatgctctgagtatggtgcagatgatgtcaagattaatgtggattctgtaattggagaggatgaaattccagttatttttacaactgaaggagattccatgcttcctaccataaaaagtggagataaggtcttggtgaataagagtcataatattcacgttggaaaccttgtttcagcaaactcttcagagtatggccctatctgtaaaagggttgctgatatagatggagattcagtttatcttgtcagtgacaataagaaggttactcgcgagtattatgatgattattatgtggaatataagggaatcactacatgggttaatattgatgatattgatggtgtgattattgacattatgaattaa

SEQ ID NO: 787 - DNA, 858 bp, Methanobrevibacter ruminantium
atgagcgaaaataatagaactttgattacaataggaatcggcgcttttattataattgccatattattattaatagcccttgttttaccattcagtaatttggcagttgacaatgatgaaatagcagtaatcaccataagcgacacaatcacctatggagacaatagcacttctgcccatacaagcaaaaaggaaattgaaagcgaacttaacgatgcctactcaaatccaaagattaaaggaattgttttggatatagacagtggaggaggaagcttggtggctagcgatgaaatttcagacttaataaagaaatctcctaaaccaattgtaagctatattggagataaaggatttgatgaagcttatcaaatagcaagtgccactgattatattttcgcaagctcctcatcatctcttggaggaatcggccttagctatataaatacagacagatactccgatgaaaaagtcacaggagtctttaatgaaaagtatctaaaaaacaataaaacaaaaagcaattctaaagtcaaaagtgcaaatgacttagcaaatgctcaaaagatggttgatcaggactatactttattcattaagaaaatcgctgaaaacagaaacttaacagcagattatgttgcggaactggcacatggcaaaaaatataatggaaatgaagctaaaaaactaggattgattgatgaaatcggctctaaaagccaatcaatagaaaaagcagctaaattgtcaaatgcaactaattatacagtaatcacttatccagagcctcaaaagaaattaactgagattttaggtgaaaatgatatttttaaccttaaagagttaattaaaatctaa

SEQ ID NO: 788 - DNA, 690 bp, Methanobrevibacter ruminantium
atgggaaagatatttaaaattgttacaatcatattgattgtcattgcattggctatacttggtgttttcatctattctgatggacattctgaaaagattggtgaaaataatcttggtgtggtgtataaggttacatatggtcattctaatgaccctaatgtgacaatcggaattgtttcaggcatgcattcaagggaaaagcttcatcaatatgtattgccatatgtttcaaaggcctttgcgtttttacatcctgatgtgaagattgtaaattatattgttaatgtaacgaaagatcctgaagactttacgaaaggccgtgccaatggagaatctttagttcatgattatgttgtaaaagatgttaaaaaagaggactttgatgttgtaatcattggacatgaccatgagccaggctatggtgaggcatattatatagcaactcctgttatggataatgcttctgtaaagctggctaaaaaggttactaaagatattggcttcaatcattacactaggaataaatctcaacctactacaagcacatccattttaaaagtggataagccaattgttgatgctggcacaagggtattcgtttatgagattcctgaagttgatggtaaggtaaatgcattttataagtcttatcagttagttaatgctacttataaccgattgaaaaaataa

SEQ ID NO: 789 - DNA, 1024 bp, Methanobrevibacter ruminantium
atggataagaaaacaatcattatagctgcagtagctattctcgttattgctggaattgccgttttcgcatttggaggcggcggaagcagcgatagcgatccgacccacttgacagtagctacacacagcaatatggcagaacctgaagcaggtttcaacccgcttacaggttggggttgcggacacatgaactataacccattggtacaaagctgtctctttaagacagacaagaatggagacatagttccagaccttgcaaccaactattcaattagtgctgacggtttaaaatggactgtaaaggttagagatgacgtcaaattctcagataactccacttttgacgcaaaagacgtagcatttacattcaacactgcaaaagacactgaaactgatttagatttaaccaatcttaagaaagttacagctaaggatgacaagactgtcgtatttgaattggaagaaccaagatccacattcatctatgacttaaggtatgtaggtatcgtacctgaagagtatgacaacgctacctacggcgaacacccaatcggtaccggaccttatgtattggaccactgggataaaggtcaacaagctatctttaaggcaaatgacaactggtatggtgacaaaccttacttcactcaaatcaccatgttattccctgaagaagctacctggctagagttagctaaatccggtcaagttgacattgctcctgttgcaacctctgcacttaacgaatctgtagacggatacaactttgttgaaaagtctgcaggtagggcacaaggtatctccttgccatatcttgaagatactggaaaaaccagcccagcaggtgcaaagatcggtaacaatgtaactgctgacaagtccatcagagaagcattgaacataggtgtcaaccgtgataaaatctgtgaagaagtattctctggtcacgcttcacctgaatataccagcgtagataccagaagctttgcaaaccctaacgctaaagtaaaagatggtgatg

SEQ ID NO: 790 - DNA, 1024 bp, Methanobrevibacter ruminantium
atgaaattaaataaattcttcattatcagcataatattgattatatttctatcaattagtgcaataagtgcagaaaatactgataatgcactctcaacagatacacactcaaatgacaatgtactctcaacagattcacgatcaaatgagaatgcactcacaaacgagaacacactcttaacagatacacactcaaatgagaatgcactcacaacagacccactcacaaaggagaacacacattcttataaggattcagaaaagtctctttcatcagatgcttttaataagaccatttatgtaaataaaaccggaagcgatgagggagatggaagcgaagcaaatccttacgctacactaaaaaagtccatttcacaacttgatgactctgacaatgctgtcatctacatcggtccaggcaattacacaggtgaaaataattctgccttggagataaacttagaccataaagatcatgacggatcccttagcattattggagattcaaatggaggaactgtttttgatggggaaaacttaaatccaataataatatcaatcagtgaggattcaatagtgaccttaataaatatcacattcactcacggcaaaaataatatgggctctgccattagaagttctggaaatctcactattgacaattgcatattcacggaaaactatgcaacaaatcttgctgcactttatgttgataaacatagccctttaacagtaatgaactcaaaatttttagaaaatagggccaaacaatgtgcagatatctatttttcacaaaactcagaaataattttattaaataatctctttgaaggttcaactgcagaatattcctatgcctatagcccatccgtatccctgcaaacaggaaaaagtttagtcaaaggaaatacttttaagaatctgacaggcgcttattataaaggtgcattgtatattgcctataacaatgggataaatatagccaacattactgataatacattcatcaactgtaattatacag

SEQ ID NO: 791 - DNA, 825 bp, Methanobrevibacter ruminantium
atgaagaaaaaaatagcaattattttaggaattgcattattagcattcttagtcatcggcgcatccagcgcaggtttcttagactttttaggtggcgatggaactgctactaatgatgacaatacttttattgtcggttttgatgcagaattccctccatacggatacaaagacgataacggggaatatgtaggatttgacttagacttagctcaagaagtatgtgacagaaacaactggactttagtaaaacagccaatagactgggatgctaaagacagcgaattggactctggttcaattgactgtatttggaacggatttaccatcaacggtagagaagacgactacacctggtctgaaccatacattgacaacaagcaagttgttgttgtaaaaacagattccggtattaacagtttagctgacttagatggtaagattgtagaaacccaaaaagattcatctgctttagcagctcttgaaggggacaacaaaaccttagctgacacctttaaagacttaactcaagttgctgactataacactgcatttatggatttagaaaccggtgcatgtgatgctgtagctattgatattggtgtagctcaataccaaatcagccaaaaaggaagcgaccaatacaaaatgttagatgaagaaatctcatctgaacaatacggtatcggtttcaagaaaggaaatgaccaattaaaagatcaagtccaaaaaactttagacgaaatgtttgaagacggaactgtagaaaaactcgcacaaaagtacgacacctacggagttcctggcgctcttattcaaaaataa

SEQ ID NO: 792 - DNA, 345 bp, Methanobrevibacter ruminantium
atgaatttcaataaaaaaattttattaataatagcattggtattcattgctagtgttggcattgttgcagctgaagacgcaacagttgatccatacactttcacaataccagatgactacactattgcaacatccgatgacactacctgtgcaatgcaaaaggatgcaacccatgccataagctttgcaaccggtgtcagcgatgatatagaagcagcaaaacaaaatttcatcagtcaaggaaaaacattgcttaaagaagaatccatgaactataatgacatggacatcacccttcaggcattctctgctgatgttgatggaaccaccattatatgtttataa

SEQ ID NO: 793 - DNA, 822 bp, Methanobrevibacter ruminantium
atgaaaagatcaatcatatttttaacaattatattatccttatttttagtaattggctatgcaagcgctgggctttttgatttttcaagtgatgatgctggttccggtgaaaatactgatgatgtatttgttgttggattcaacagccaatttccaccatttggatataaggaaaatggtgaatatacaggatttgacattgaactggctaaagaggttgctcgaagaaacaactggacattcaagccagtgccaatcatcgattggaacactaaaagatttgaattggacagcaatgaagtagactgcatctggagtgaatttaccattgacggaagagaggacgactatacatggtcccaaccttactttaacaatacaaagcttgtcatcgttagaggggatagcgatatcaatgaccttgacgatttgaagggcaagacccttgaggttcaacagggaagctccattctaaacacaatcgaaaagaatgagactttaaagagaaaatttgcaaagattgagcaggtggatggctatgacactgcattcatggacttggaatctggagtctgtgatgtgataatcatagacagcggtcttggaagatatctagttagcgaaaagcataatgacactaagatattgaatcagacaatttccaatgagaaatatggtgttgcatttgaaaaaggaaacactgaattaagggataaggttcaaaagacattggatgagatgtatgcggatggaaccgttgaaaagatagctcaaaagtacagcaaatacggaattccagatggtgtaatctatcctgaataa

SEQ ID NO: 794 - DNA, 1024 bp, Methanobrevibacter ruminantium
gtgggcataacctttacagcaatcatcacaggggcattaggtggaactactttttcagaacctttaggaaactaccttagccaattcataccttacagctatcagataagcttcattatcgttatccttctcacatcctactttacaatattggtaggtgagatcgtacctaaaagaatggcattgaatgaccctgaaggatatgcattgagcactgcaaagttcatgcagataagctcaataatatgcaagcctattgtaaagctccttgacagctctacaaatcttgccttaaggattgttggcccatcaccaaaagaggatgtcgttactgaagaggaagtcaagctccttatcgaagagggcattgaagacggaacaatagccgaagaggaagaggacatcatcaaaagggtattccgtttagatgaccaaaaggtagatatgataatgacccctagaaacgagatcatctggctagacctagaagatgagattgaaattaacaaggctaaaatcattgcaagtaaaaggtctattttccctgttgcagatgcggaattggatgacttcatcggtgttgttcaagctaaagacctactcagcaaaatatttgaaggagaagatgttgacattagagctaatgtcaaatctccattagtagttcctgaaaatatgctttcaatggacttgcttaaggaatttaaggaaaacagagaatatgtacatatggttcttgtagtggatgaattcggaagcgttgtaggactcatcacattaaacgaccttcttgaaggaattgtaggagacattccaggaatcgatgaagaggacgatcctaaagcggttgaaagaaaagaccatacttggctaatagacggcagattctctatagaagactttaaagacctatttgaaatcgaaaaggaaatgcctaatgaagtggaggacggatacacaaccattgcaggattcatcctttcacatgcaggtaaaatccctgaaaccggtgaaatattccatg

SEQ ID NO: 795 - DNA, 504 bp, Methanobrevibacter ruminantium
atggattctaaaaaactgattttagtgactgcattggcttttttagctattgtttccatagcttcagttagtgcatgggacttgtttggaacagctgatgagactagttccacagcaaagactaccattgcaggacatgatttcaatatacctgacggatatcaaaaaaatgagtcatatgtgttggataatgaaactaccaactcaaatggggctattttttattcaactgcagagagctattataagggtgcagatgatataatttatattcaggtagcagactacagttatcctggttatgaagctaatctaaccactgcccaacttctaaagtctggattgggagataaagaaaccatcaatggtcatgaaggtttaattgcagaaaatgaatttgatggcttaaaggttcatgcatttttctatgctgaagatggagattgtataactgtaataacttcagatgataatttatttgaacaaataattcctgaggcatga

SEQ ID NO: 796 - DNA, 1024 bp, Methanobrevibacter ruminantium
atgaatgtgaataagaaaatatttttacttgtaatctttataatatctatttcaatagctggagtatattgtgcagacatccatcaggatagcgatttaaccgcaattctaagcaatgaaacagatagtggtttaacagctatcatgagcaatgaaacagatagctttggctgctgttcaattgtcctccaattagatggaaatgaatccataatgtgctacagacgtgattccaactatacagcagatgtatttattgaaaaggtcaattggcatggaaagcctgcaataaagcaatataaaactgacaataaatacttcaaccatgtcataatcacaaatgatggctggataataggattaggtggaatagacgatggaatcgacagtgaaatctgtgaaaacatcactgcaaagatgattacaaaggattacagcatctcagaagattatctaactcaaatccaggagattaaaaagaagtatggaagaggtcatgttgtaattaaggctcctaatggaaattacggctttgcaacacctacaaagctcaagacagggacattaaacgttggagaatacatatccatcccaaataattatgagctttccagaagaggatatgtctcactggatgagccagataaaatagaggcaatgataaatctatctagaactgacctttatggagatgacagacgtgaaataattacttatgacgttcatttaaatggcaacaacaatacaaccgacatttacatatccaatgaagatggatcacttattggaaaagactatactggctgtgttgacaatgtaatcttcaataatgtgactatagaaggaaaagacattcctatagctccaaactataaaagcctaggttcaatgagctttgaagtagataaagtcaatcttagcctaacagatttagcatttatagttgtaggagtagttctagttatagcactcttattcgtcttattgctaaggctcataagatttattaaaacaagaagatcca

SEQ ID NO: 797 - DNA, 453 bp, Methanobrevibacter ruminantium
atgatactggcactattttgttttatagtcattggctcagcaagtgcagcagactttaaaatcaatgatggctttaacagctcactgtctgattattctttttacaatgaagaccaaaacatgtacattaatatctgggattatgatgatgagattcttagcgaagcatatctggaaaacagcagcagctatcgcatagtttcaggagaaaacaatacatataactttgtttttgacagctataacgatatggatcatgtaatctcctatattaccaaaggatatgttgccttagactgtggagtattggaaatagctgaagttgatggcaaaaagcaaatcattttggtttctaaagagggaacaaatgtagatagcttgaaaacatgttatgatgaattaatgaaattcaatcagaacaataatatagagccaatagcagatgctatataa

SEQ ID NO: 798 - DNA, 1024 bp, Methanobrevibacter ruminantium
atgatctcactgcttcttatttcaattcttgctataagcgcagcaagtgctgcagatgacatggtagacgcagatattgacctagcaagttcagaaattagtgaagtaagtgtagatgatgtacaagctacagataaaaatgttttatctgatgcagatgaagtttcagtagttacacaaaacactccttacaatgaaaatgcaactattgatatcagcgtcaacggcactttagctgatgacagcaccataaaacttttcattgacggtgaagacaaaggagatttaaatctatcagcagaaggaaaagcaagttatgttattccagcaagcactctcgatgtaggaaaatatttcattgaagcagtagtacataatggaacttcctcatttggaggcagatccaccctcaacattactaaagtcactcctatcgtaagcgttagtgatgtaactgtaaaaagtggagattatataaccattccatttaatgtaactgatgacaaaggtaaagcaatccctggagatgtcattgtaacaatagtctgggaaaatgatgtaataagcaaacatattaaactaaacgacaatagctctgcaggatttaatattgctgatattattggaatatttggcggaaacagcacaggtaacggaacaggaactggaataggtgacttattcaacagaaacggaaccaacggaactggaaacggaaccggaataggtgacttattcaacagaaacggaaccaacggaactggaaacggaaccggaataggtgacttattcaacagaaacggaaccaacggaactggaaacggaacaggcatcccaggtattggcggaaacagcacaggtaacggaactggaaacggaaccggagacttcgatattgcaagcattctcgcaatgttaatgggaggaggcaataataccggcgctaaatttgcatatgtctttgaaaaaggagtctataatgtaagcgttgaatacttaagcaacagaaactacaatggagcca

SEQ ID NO: 799 - DNA, 384 bp, Methanobrevibacter ruminantium
atggaagaaaaaattgctttagctgcttgcagtggtatgagtccaaatggtttggttgcaagagttgcagttcatgatttggctattgacgatcatgagattttatctatttgtatgggttcaacttctgcaaatgtggaaggatttacaagagttcttgataaatatcctattttagcaatcaacggttgtgaaggcaactgtgttggtaaaatcttaaaggaaaagggtgttgatattgtaggagaacttaatgttggagatattttagcagaaactgaatacaaggctaatgatgctgcaaggttagatgatgaaggagaaatctgtgtaaagattgtaaaggacattatagaggataaaattaatgaattaagtgaataa

SEQ ID NO: 800 - DNA, 459 bp, Methanobrevibacter ruminantium
atgaaaaactggaaaataattggattaatattaatcatccttcttgctgtcgtttcagttagcggctgcattggtgatgactcttcatctgataccacatcaatcagtgcagatgcccttaatattacagaagatggaacctacgactccaaggaagaggttgcagcctatatagatgaatatcacaaacttccttccaactacattaccaaaagtgaggcaaaggctctcggatggcatggaggcagcgttgaaaagtatgcacctggaaaatgcataggaggagacatattctccaatcgtcaatcaattcttcctataggccatgaatacaaggaatgcgatatagacactcttggagctgacagcagaggccctaaaagaatagtcttctctacagacgactatgaggtttactataccggagaccactatgcaagctttgagcacttgacttaa

SEQ ID NO: 801 - DNA, 1024 bp, Methanobrevibacter ruminantium
ttggttcagaatactaatctaagcaataatacagctgtcttcaatgaaagcagaaatgagacatctggtattggtggtgcattagacgttgttggtaacaattgtcaaatcatcaacgtcacttccgataacaacaatgcttatcgtggtggatccactttcattcgtggtaatgacactgtcattagaaattccactttcgacaataacaatgctacccttagaggtggtggattgaacattgctggtgaaggatgtaccatattcaatgtagatgtttcaaataacgctgctggtgaaaacggtggaggtatctacgtaattgctgacggtaccgaattcagaaacattactgctgacaataacactgctgaacgtggtggaggcgcattcgttgaaggtaacgacatcattatcgataatggtactttcaatggaaacaaagctattttcaatgaaagtaaacctgacgaatcaggtattggaggtgctttggatatcaaaggtcatggctgtaatgtaaccaatgtagactcattcaacaacaccgcttaccgtggaggttccactttcattcgtggtgacaacacctatcttgaaaactgtaccttagacggtaacaatgctacccttagaggtggcggtttgaacattgcaggtgagaactgtaccatccacaacgttgacatttccaataacactgctgggctcatgggcggtggtatctatgtaatcgctgacggcactgtctttagaaacattactgctgacaataactctgccgaacgtggtggagctgtttttgtcgaaggtaatgacattataattgataatgctaccttcaatgacaataaagctattttcaatgagagcaggccagatgactctggtcttggtggtgcattggacattaaaggtgatggctgtaatgtaaccaatgttaattcattcaataacactgcttatcgtggaggttccactttcattcgtggtgacaacactcatgttgaaaactgtaccttgg

SEQ ID NO: 802 - DNA, 1024 bp, Methanobrevibacter ruminantium
atgagaaataaaaagattttcatttttactttaatgattgtcatgctattatcgcttgctgcagtttcagcaaatgatctggataatcttgaagttgatgatggaaatgttgtatctactgatacggtaatcaatgatgtgcccatggagagtacgtctagtgataagattgccctgaatgtagattcgacacaatctaatactacagagatacttaatgaaaatgaaataataacaaataatagtactttaagcattgatttgaatgaatcgattacaaatgaaatcagttctgatcatgaagattcatatcaggctgatagtaatcaagaggattcctatttcacttcagatggaaacatttatgttaaagtgaaaacttccatgcttaaagcggacggcgatcagatttattatatacatcctgccggtagccctacagcaacaggaactcgcgatgatcctttggatagtatgaattccgccttgaatttatttacttcagatggaacacacactattgtggttatggatgggatttataaagatacatactatgactataacaatacagatgtagacacaaacttaagcaacttgattataaagtccgatgaaggggcaagtccacattttaacctgagcacttcagattatcgaaggtctttatattgggcctttacaggagaaaacataactatagatggattgaagtttactgattcacaatacggctcttttaatgaggatggggtatacaaataccatacagtattgagattcattaattccactaatgttttggttgaaaactgtgtatttgacaatgacggataccttatcaatgcaactgattcaagtgatgttgttattaaaaattgtaatgtttccaatagtaatcgttcaaatgtatttaatgttttgaattccagctttactgttcaggattcaaatttatccaagattagagatagctatattaccaattcaagttttaagctaatcaacaacaccatctgtaaca

SEQ ID NO: 803 - DNA, 1024 bp, Methanobrevibacter ruminantium
atgagtattaaacgaatattacttacgagtttaatgctatttataataatattttcaatttcgtttgtaagtgcaaatgaaaatgtaacaaatgacgtaagtacgaatgaactatcaacacaaactgtatcaaacgatataactactagtgaaagtataagcgatactagtctagactctggagaaaaccggggtttggatgagatcaaatcgaattcgacagaagagtcatcatcatccaatttggaccttgaggatggcactttaaataacgatgaaattgaaagtgatgattgtttaactaaaaatggaaaagaagcaacattgcaagcaaataaacttagtcttgacattaatatgagtagaggtacagcccaagatgtactggacgcaatcgtacgaatttccagtcaagggggaggtacactctatctgaatggtggaacctatactgaaggaggccatgccagagtttataataatgacactgatagtttccgtaatatcgtaaggaacgatggaatagtagacatttcaaatgttcgcgtagttggtggtagcgtagacaatccaaatcaatatgctacatttcaaccaaatactcgtgatagtacttcattggcctttagcggttacggtgtttgggatggtaatggaactagatattaccctgattccggttttaatttaactaacgttacttttgaaaatttaaactgtacaggtagattctttagttttaacagcgggtatttgacagattgtgtttttaataatctggagtcctatcagcacctcttcttcgtaactggagcttacaatgatggtggtaagccaatagtactaactaattgtaacttcaccaattccaaacaaacttacaggggtgacggccctggggatggtactgatggtaccggtcagtttggtgtagtattcggtgctgaaatgtatggatgtaacttcatcaatacaagcactgctactcacggtggtgctttttgtctttcagacgaatggataa

SEQ ID NO: 804 - DNA, 972 bp, Methanobrevibacter ruminantium
atggataaggtaggaattataggagcaggtagtctaggtacagctttagctcaaacagtggctaataatgtagatacagtttatctgcacttaagaagagaagaattagctaaaacaataaattcaactggatataacagcgaatactatccaaacactaaattaaaaaacaatatcatagccactactgacatgaacgacttgattgattgtaagataatatttttatcaattccttcatctgcattcagatcaacccttgaaaacctaaaagaggtcatttcagaagatacaatacttgtgacaacagcaaaaggtattgaatatccctcattgaaatcaatgggtcgcttgatagaagaatactttgatgaaaacttcgtagccttgtcaggccctaattttgcatctgaaattgtcttgaaccttgcaaccgtatcaaacattgcttcaagaagcagtgaaaatgccataaaggtcaagaaagtcctatccacaccagaattcaaggtaaaaatcattgatgatgttgtaggccttgagatatgtggagtcatcaagaatatcaatgcaatagcaaacggtatctgtgaaggaatgaacataaatgaaaacgcaagatatgccgtcttgacaaagggctttgaagatactggtaggattatagaagcatttggtggaaaaatatccacagcaagcgaatactgtggattcggagaccttgtgctaacctcaacttcaagtgaaagcagaaaccacacccttggaatgctctatggccaaagaatcatcgtagatgaaaaggcaagcggtatagtatttgagggtaaaaactcaatcatggccataaaggacatctgtaataataccaatactaacagtgtggttgtaaactttgtatatgatgtaattgttaaacagattccgcctaaaatagcttttaaagacctatggaacaatattgaggagtga

SEQ ID NO: 805 - DNA, 1024 bp, Methanobrevibacter ruminantium
atgatgagtgaagattcaattttgcttactataaaatcttttacagatttacaaactgaaataaacaatactgcaaatggcggaatattaatcttagaaggatattacaagtataatagcaatttagacagtaattttttacagaaaggtgtattagtaaataaaaacataaccatttttggaaatgggtgtgtcattgatggaaataatacttcaagtttaatggaaattaatgcaaataacaataccgttaaaatttatgatttaaattttattaatggtcaccaaaatacttggaactatggaagggttagtattacaaattctattgcttattttaataactgttcattcttaaactccacaaatggttattatggtagtgtatatatagcaaaaacatctcaagcacattttaacaattgtatattcaataacaattatgcaaaatttggtggagctatcttcaataataatattatgtattgtaaaaattgtagctttgaaaataacagtgcacagtctggaggttcattgtgtataaatggcgaaaataatggagtggaaaatacaaacaattatacttacttagaaaattgctccttttcagataactcttcaacagcacatggtgcagtaatatattgtgatgaatggtcaaaaggttgtttcaataattgttcatttgaaaaaaattctgcaacaacaagtggaggagcaataacaatagatggtgcaaatatagatataaataactgtagtttcaataaaaataaaacaggaacatcttcaacatacaatggaggagctatttggataattaaaaatgatataagcggtgcatctaatgtaaatatattaaatacttcatttagtaataattctgcttctcaagatggcggtgcaatttatttaaatggaacttgtgtgcttaaaatttcaaactcttcattcaataataatactgcaactagatatggaggaagcataagaaattatcaaggaacagctaccgcatatctat

SEQ ID NO: 806 - DNA, 264 bp, Methanobrevibacter ruminantium
ttgatctgtagcatacaggcctgctcggcctcatgcactgcagtctatgtagggcctgatgtcagtgcagacggttcaacaatcattgcaagatgcaacgaccatcagggagtttggggaaaccatatcacagtgaccccaagggtagagaacaagtcaagccgtcttatggctgtatgcgaagatggaagcgtaaaaacagagcttccggcaacaacttacaaatacacagccacaccatatatgaacagcacaaaagcatga

SEQ ID NO: 807 - DNA, 786 bp, Methanobrevibacter ruminantium
atgaaaatatcaagaattatacttatattattgctttttgttgtattttttgaaataggactgttcagctcatataccatagtaaatgctgaagttccaaaccctcaggaattatgggatatgcaggtaaacactgttagttcattcttcagccctgaaaatgtaggcggattgcttattaaggatccagataacattaacgttacaaataaatatgatctggccacagaactggctgaagtggcagaggtggatggagtcaatgtggaaaatatgacaatcactacaagtgcagatactgatgaagagccattcaatgcaactgtaactgcattcggttattccactcctaaaggaaattccggttcaatcgttattagcggacagcctgattataagattgtagcttcagttcaaattaagcataccataaatggctatgaagcggatttggacactatcaatattgaatccatattaaaggtatatgactcaaatgacgctaagaacgtaagctattccggttatgattcaggacctagcggcgcttctcaaagctatagctattcatctgactcttccagttcaaatgataatgcttatatctcttcagattcatccagtggcagttcaagctatgacagcggagcatcttcttcatctggttcctatagtggaggttccagttatgatagcggtgcttcttcaggttctggttcttcttctggttctggaagtggagatgtagtgattaatctattaagtcctatattttcatttatttaa

SEQ ID NO: 808 - DNA, 1024 bp, Methanobrevibacter ruminantium
atgattttaattatttcactattccttatttcattactcgctatcggtgcggcaagcgcatctgaagacataactgatacaattgaagcacctgctgctgatgaagtagtaacagttgatagtgaaatccaagaaatagaaacggttgataataaccttgaagaaatagaaaccgatacaaataatattgaagaggtggaagctgctgacgatgaagtcataaatgaaacagctgaaactgaaataaaagacgaaaccgaaattacagatgaaactatcatatctgaagaaaaggttcaaatcgctaatgatgaaaaaatcgtccaagacggtttgcttggctttagcatcaatttaacagacctacttggaggagaaagctcaagccttaatttgagcaaactcttaagtggagacaacttaaaccttaatttgagcaaactcttaagtggagacaacttaaaccttaactggagcgaactcttaagtggagatagcttcacccttaactggacagacctattaggaggagacagcctaacagtcaactggacagacctacttggaggagaaagcacaaccctcaactggacagacctattaggtagagacagcctaacagtcaactggacagaccttctcggagaagactttacccttaatttgacagacctattaggtagagacagcctaacagtcaactggacagacctattaggaggagacagcctaacagtcaactggacagaccttcttaacggagacagcttaaccttcaactggacagacctattaggagataacctaacactcaatatgtcaagccttttaggtggcgaaagcacaaccatcaactggacagaactgttaggtgacaatttaacattcaatatgtcaagccttttaggagaagactttaaccttaatatgacaagccttttaggagaagatttcaaacttaacctaacaaacatctttggagataacttaacagcaatctttggagaaaacttaacaaacaaac

SEQ ID NO: 809 - DNA, 1024 bp, Methanobrevibacter ruminantium
atgaaattatataaaaatagcataatcattttattattaattttaattttatcgattggagcagctgcagctgtagaaaatgattattctaatgccgatttagatatttctaatgattttgttttaagtgataattctaatgaaattttaatagattcttctggctctttagatgattcttctagtgccttagtttcagaaggttcttctaatggattggattcatattattctaatgatttggttttaaatgattctttatcttctagatcatctgtgattgaagactcttgttctattgactcaactactattgaagataaggccttagaaaaaagcttgtcttcaaatgaattggctgaaggcacaaagacatatacagacctgctaaaggatataaagagtgctaagaatgtgcttaacttaaaatacgactatatatacgatagcactattgacaaaagtcttaaaaaaggaatcgtattaacctttgatgaagactatgagcttacaatcaatggaaacggccatattatagatggaaatggaattgctggtggatttaactttgaaaatggtgaatttgtcataaataaccttagctttcaaaactgtaagatatcctctctaatcttaactagctgtgatttcactacaaattatgtcactttttcaaacaattatgacaagagctctggtgcatgcgtatatcttgacaactcttatttctacagcagtcatgataattttatagataactatgcgccttcaggatcagccatctatggcgaatgcagtgtaatagatgtttatgatggcttatttgagtctcaaaaaccgattgactggtcctttatctatggatgggatgagactgaaatatatatagaagactgtttgtttagaaacaccgtatccaattactcaactgcagtatatggcgattatataatagaaatctccaactctcattttactaatctattctccaaattcacaggaggagccattggagtaaggaatg

SEQ ID NO: 810 - DNA, 1024 bp, Methanobrevibacter ruminantium
ttggcagtgattttgataatcctattttcacttggaactgttgcagcaagtgaaaatatagttattgatgagtcttctgattccaatttagttatagaccatgctaaggataattatttattcaatggacctataaaagataattatttatctagcagttctattagtgataattatttatctaaaggtgttcttgatgattcttatttatcaagaagcgatttggatgattcttatttatctatggatgatggcaaaggctctatcgatttgacgaatcataatcaactatctaattcagatgataaacagcttaaaacttctaatttagaggatgaaaaacagcttgaaagtgtaaataaaggagataagcttcttaaagattcaaatgacaatgtcgatttgtttattaatatggatgtaaagacatcattgaccaacaagcaatataaccgtgcaggaagcgaagttccatggattataactgtttcctctctcaatggaaccagctataatacccaagttcgtgacgttttatctgaaaatttacagtatttatcacataatgctacaatgggaacattcgatccggaaaatggaatttggactgttggtgacttggaatcttctaaaaatgcaagcttgacaatattgacaagattgaaaagagatggtacatatataaacaaggcttatgctactaccgattcaaatgatgttaatctattgaataacttcctaatcatttccataaggaccggttcatcaaagatcacttctaacattacagagacaagtgatgaaagagagggaattcagcataatgttcattatgctagtatggttgatacggactttatatatagatatgaagaggactcttcagaagacgatggcggcaatgaagaaggccaatctgaaggaaattcccataccaagactagatctttaggaaataaattgaaattattcaatgctcagaatatagattatcattctctttccaaaaacatcggtggagcat

SEQ ID NO: 811 - DNA, 1024 bp, Methanobrevibacter ruminantium
atggttctagtgattggaaccatttctgcagttagtgcaaatgaatgcgctaatgacttaacgatggagataagtgatgataatatagctattgatagttcttctgctttagaaggggatgatttagctattgatagttcttcttcagatttaagtaatgaaaataatataaattctatgaatgatagtgtaattaattctaattctattaattctgattctattaattctgattctattaattctgattctattaaccctaatcctaatattgatgatgaaataaataaccataaagatagctttttaaaggctgtacaggcctctaaaaccggaacatttacagagcttcaaactaagataaacaaggcaagcaaaggctcaacaatctatctggataagaattacctctataatgatgactttaaaggcaaatatggaatagtgataaacaagtctatcacaatcgatggaaaaggccatgtcattgacggtttaaagaaatcaaatctgattttcatcaatgatgcttcaaacgttgtctttaagaacataatatttagaaagggcgacggggacgagaatggagctataaatcttattggctctgatcatatcgagtttaacaattgcagcttcaattataactatggtgataggggtgctgtatttttatccggcagcgattactcctcctttgtaaattgcaagtttaatgagaatattggggagaacggcggagctcttatattggctgatagtgattattctcgccttgtcaactgtatcttttttggaaatgaggcatctgacggaggagccgtatttataacttatagtgattattcttactttttcaactgtacttcagagggcaatagcgtagattatacaggaggggccttttatttggattattccgataattcctctttcattgattgcgtatttgacacttccagcgctaaggatggcggtgccttttatttaggcgattgccataattcctctttcattaactgta

SEQ ID NO: 812 - DNA, 468 bp, Methanobrevibacter ruminantium
atgagaaaccctaaagattatattatgaagactgattatttgattattcttatggccttattgctgatttctatagtttcacctatagcagctgcagatagctttgattttgatattccagagggctatcatatagagaatgcaagcgatgatttcgtactattggagaatgaggactattatagcatttcaatttccattatggacaattccacagacaggaagactctgatggatatgcttgaaaggcacaggtgctatgactttagaaatggtgtcaattataccaaaggggatttttatatagaggagaagccttattatcaggagttccaaatgggaattttgtacttttgtgaaaatggtagagatcttgttgtgattgattataagggacctttaggtatggatttgaataatagtcctatagatggcattttggatagttttaagtgggtaagttattaa

SEQ ID NO: 813 - DNA, 471 bp, Methanobrevibacter ruminantium
atgaataataaaaagatatttgtggccggattagccatattggctattgttctaatgggatcagttgctgcagttgatatgggcattcttagcggaagcccaaccaaattcagcattgacggcatcgacttcaatattccacagggatatgcagttactgacaactatacaagagtgaatgatacagacactgctggaagctcaagctatagggttacccaagcaacctttgaaaacaatgtacatgatgccatttcagttcttgtagctgattatgatcatgacatgagtgaggatatcatatctcaaagaggcaataagacaactataaatggtgtggacggatatatgcaaacccaaggggattatactacattcaattatcttgttgatgggaatcttgtgacaatcactcttacaaatgcagatttgcttgaggatattattgttggtaatcagacagatgactga

SEQ ID NO: 814 - DNA, 1024 bp, Methanobrevibacter ruminantium
atgtccgaagatattggaatcaatgacaataatggtgctttgatagcagacgttaactttgctgatgacaataataatgctttaaaggctgaatccaactctgctagtcagaatgacgcttcaatagatgaatctgctaatcccactcaagatcttgtagatacagataatggattaaaccaatccatcactaaaagcccactaaaatccaatactggcctcactgttacaaaaacaattgataacagctctaaccatatgcctgtagacggattttacgacattggagacactatctactataccatcaacataaccaacaatctagaagaaagcataggcaatatcagtgttgttgaaaacttccctgatggattgatatgggaatatatttggtttgctgatgacaatccaaattggaaaaatgagagcaatgtattcaattatacaaaagcattagagcctgaacatagcatccttctcaagatacgtatgacaggaaataaaacaggcacttacattaacacaatcaatgtaagctccaacctaacaagctctcaagagttcttatccgaagaagtgactgtttatgctccaaatttaacaattacaaaagtggccaatgatccaatcgttaccattggagaaatagcaaactttacaatcaacgttaccaataacggaaataggccattaagtaatttgcgtatctatgaagatcctgaagaatcattattcctaaatgagttcactaacataagtggaaattgggactcttttgcaaatcgtggtggagattacggttttagcttggaccagctggatataggtgaatctgctgctataatagtatcttttttaacaacagaaattggaaatttcaccaataatgtctatagcaactatccgaatcctcaagtagaggcaaatgccactgtcacagttgttccaagaattgaaaagactgtcaatgccactgaaattgatatgggagagtctgttgaatacaatgtttacatcgaca

SEQ ID NO: 815 - DNA, 978 bp, Methanobrevibacter ruminantium
atggactttaataatttcaaatatcttgatgaattgattcatagtggtgcaaaggaaataaatctagactcagacataatcctagaggacaaagaagagcaaaaatattcagatggaattaaactgaacatagacaatctagtcatcaatggaaatggccatatcattaacgccaaagaaaaaacaagaatattctattccacagcccaaaacatcacaataaaaaacattagattaaaaaatggaaaaacaaatacaataggaggagccatatacaacctaaagggcaaaataaaaatcatagaagccacaataaaagaaaaccaatcaaaatatggcggatccatatacaatgacgaaggagaaatggaaataataaagtccacattcacaaaaaacaatgccaaatcaaatggaggggcaatccacaactataaaggcaagatgagcatagaggaatcaataataaatgaaaacaccgcaaagcaaggaggagcaatccacaactatagagccattctaagcatagaaaacaccacattaagaaaaaacgatgcaaaagactttggtggagccatattcaacgatggcaatgagttaaaaatcaccgaaagcacaatagaagaaaacacatcaagccaaggaggggcaatatacaataatattggagaaataatcataaaaaactccacaatcacaaaaaacatagcaaaaataggtggagcaatccacagctggaacaaattaagcataatatcctccacactcaataaaaacaaatcatatgagtatggcggcgcaatacataatttcgatggagaaatattcatcaaagactccataatcaccgaaaacatatcaaacaaaggtggaggaatattctcaaacaataaaaaatacaaaattacgacttccaccatcgaaaacaatgaatctgacaatatccatgaaatagactcatttttagacatggattga

SEQ ID NO: 816 - DNA, 1024 bp, Methanobrevibacter ruminantium
atgagcaaaagttttagagaccttgaattattgatagaaaattgcgacgatgagatagttttggattcagacattgttttaggagatggtgaaggccctatttacttagaaggcattaatttggatagtgatgtaattattgatgggaatggacattcaattgatgcatgtgggaaagtgagaatattttattcttcaggagaacttacaattaaaaacattagcttattgaatggatactctgatgaaagcggaggtgccatagtggtagatgggggaaagatggacataattgattctatcatctctggaaactattctgctgatgatggaggggctatacacatagaggaaggtgaattggcccttataaactccacagttaaggagaataaagcaaaggaattcggtggagcaatcaataattgggacagcttgaagattgtaaactgtgaaataagctcaaatgaggcacgttttggtggagcaatccttaataatgatggcaatttagagataagcgattctctttttaaagacaacaaggcagataagggaggagttatctataatcaagatggtgacttttccgttgaaaaaacactctttgagaaaaacaaggcatctgctgatggcggagtattctataatgaaaattgtgatataagcgttattgaatccaaattaaatgacaatcaggcagataaaggtggagttatctataataatggtgtctttatcataaaggactgtgaacttataaataatagggcaaatgatggaggatctattgtcaattatgaggcagagcttaatgtaatgggttccagtcttagtggaaatctttctaattatggcggggccatatacacttatgatggtgagatgagcattgacgagtctagatttgatgataatagggcagaatgtggtggagctatctatagcgaaaagtgcatctgggatgtttctaattcagagtttaattcaaataaggctaaaaactctggcggtgctatattat

SEQ ID NO: 817 - DNA, 1024 bp, Methanobrevibacter ruminantium
atggattttagagaggaattaaataaaatattaaaatctgatgatgaagaaaataataatttaaaatcaactgaaaacaaaataaaagacaaaaaagaagacaacaacttaaaaccaatcgataacaaaataaaagacaaaaaagaagacaacaacttaaaaccaatcgataacaaaatcccaaatgaaaataaagaacctaaagagaaaaaaactccacagaaaactgatgaagaacgaatgcaaaacagacctaaagaaaccatagaccatctaaaaagatttaaagaactaaacaccacaactgacagcatatttaatataagtccataccaagtcctaatcatcctaaaagatggaacaaacatcaccgattggaaagagatagaagacaaaaaggacattctctatatcagtgaagacctgtctggagagagctatatatcaaacaaatatagagacctggaaggaatgcgccttatcatagcccaagggattacaagcaaagtccaatttatcgaatcaatgtttgcagactgcaagtccctgattgacgtaatcggacttgaaacatgggacacttccaatctattaagcttggagaatatgtttggaggatgctccagcttgacaagctgcgacggtctaaggtatctggatgtctctaacgtcaatgacatgaccgccctattcaatgactgttaccgcctaaatgacatagattcactaaaggaatggaacacatccaatcttacaaagatgtggagcatgtttgcaggctgcaaatcattaaaggaccttagaccaataagcaattggaacacaagcaatgttacaaacatgaccagtctctttacagaatgcgaatcattgaatgatataaatggcatcagatcatgggacagctctaatctaaaagatatgggaagtctcctttggggatgcaaatccttaactgacatttcagccttaagcaattggaacacaagcaatgttagaaaaatggggcgcatgttttggaact

SEQ ID NO: 818 - DNA, 1024 bp, Methanobrevibacter ruminantium
atggcagaaatgaccataagaaactccattatagaaaataacagtgcaaggaatggaggggcgatcctcaatgatggaaatctttttattgaaaagacgacttttaagaataatcttgcatttactgccggagcaataagcaatggaggatatgtttccttaaaggatgtttcaatggaaaataacattgcagttacaggggctgccttcatcaatggaggagatgcgaagatagaagacagctttataataaaaaacattgccataggtgaaaaaagaggaatgaacggcgaacatgatgtcggcggagcagtcggtaattcagataatcttttgctgaaaaacacttccttcattaataactcatcaccttttggaagtgcaatatacaatttaggcattgatattccaaaattaaaatatttatgtaaaataaaaatagaagactgcagatttgaaaacaatagctcccatataagcggtgagattcataatgagataggtgaaatatcaatagatgattccaaattcaaaaacgaaactgcaaaaagaggatcagtcatatacaatgacagttatctgacaatcacatcctgtgattttaaagacttaaaaaagatagttcataatttcaatctcatgacaatccacagctctaatttcgagtcaaatcaatcagacagcgcagttattgaaaatgatggggaaattggaatcttaagcattgaaaaaggaaaaatcgccaataatatcagcgattataccactgtctataatcatggaaaggattgcaacattacaggaactatttttgaaaacaatcactctaaaaaagaaaattgccataatatatgcaataggtccaatatggtcttaaaagaaataatcctaaaggataagactgtcagcatttttaatgagggaatcctaactgccgagaaaaaatataaaaactttattttttccgtaggcaaggttttttatcttggaatggaaaatgagtttaattttagctatttggatg

SEQ ID NO: 819 - DNA, 1024 bp, Methanobrevibacter ruminantium
atgggatttatagataaattaaaaaaaggaataggcagaaaaaataaagaaaaaagctctaaaagagatacccaaaaggacactggattgaagaggaaatctccacctattgacaaggcatcttttgatggtagcgatgaggaatacaaattatttgaaagcataatgtcctatagggacgagccagtcgtccatagtatcttaagaaaaataagtgacgatcgcctattgattgaaattggaaaatcccatccgtttcttgaacttcgacgtgacgcaatcctaaagataaaacatgcctcaagagaagacttgattgagctctttgaccttaacgaggacagatggggcatcggattaagaaacgctatcgcaagcaagttcaccaaagagcaactaatggaaataaatgatgaaaggaaattgagagagataatacgatattcaaatgaggaaaatgcaaattgcatctatgacaagataaatgatgaggagcttctcattgatatcgtatgccttacaaggtatgaaagcatacgagacaagtttgtggaaagatttaaaaacgatccagaagtgatgagaagatgcctggaatccagcagaagccctgagcttaagtctaaagtagcccaatacataaacaatgacaaggaactaaagaaatacatcctatcccaaaatgattggaacaacaccgttgaatatgccttaaatgagatgaaggatgagaaaattgcaaatgaagcattatacgaattcgcccataaaggaaagaatcagctcaacaagtcaatagagttcatgagcgatgatgagaccctattgaatattgccttggaatattacaatctggattatgacagatactactttgagattggaatggcccttgatagaatcaatgacgatagccttttagtggacctgatgcataatgagactgatgagactcttcgcaggcttgctgcaaaatacattaaaagcgaagaagcgttaaaggagttcgtcaatgaccctaatg

SEQ ID NO: 820 - DNA, 1024 bp, Methanobrevibacter ruminantium
gtgcctttaagggttgcagtagcctatatctttgaaaacgacattgactatcatgtaaactatcagacagaccttacctgccttgcaggatttgaccaaaactatacaatctattcaaatgagttcacttcaaagtacgacgagctgataggagcagtaggaacctatttcaatgaatcaggaataaaatactcctttgacatatttgtaaacgacaaaaaggtccaaacccaaaacggaacaagcgaatatgcaggatttaggacaatagttttaaataattacatccctattaagtctggagaccagttcaaggtagtcttcaagagcaattcagttccttatcaggcatggtctagggtccattacctaaatggaacatcccttgtaagcgctgatggaagcacttggaccgactttgctcctttaaataagactgtctgtcttaaagtatacacactcaatgacactacaaaattagcagacgccaatgacatgattattgaatatggcgaagattcctatttcagcgtaagggctgcaacagagaataatatatctgtaggaccaggagaggaagtcactttcaccatcaataataatacaacaacagttaaaactaatgatgagggtgtggccaaaataaagataagcgaagctccaggaacatacaagataacaagcagctacaataatcaaagctatgaaaacaatataacaataattagcagagaaagaacaagcacaagaatcctatatcagaacatgagcacagtggctgtcaattccaaggtcgatggcaggataggcaaatactttgaagtaaacctaaccgacgatgaaggacagccgttaaataacatgccagttcaaataggattcaatggagcagtctataatcgtacaacaaatgctacaggcggtgtaaaactacagatcaaccttggatatgaaggctcatacacctttgcaatagcattcttgggagacaataaatatgcaggctcatttgaagttgcaatca

SEQ ID NO: 821 - DNA, 1024 bp, Methanobrevibacter ruminantium
atggagaaaactatgaaatctaaactttttatacttctaatcattatctctattctaataagcatttcatcagtttcagcaagtgaactccaagctgatgcatcaaatatagataatgattatcaaacaaacatggaatttgatcctatctgcaatgatgaatcaaatcaaaaccaggatttaaatctgaaaaacaataatgaacatattttaaaagaagagaacacaaaccccccagaaatagaagatgaaacatgctttacaactttatatcaggaaatcaatcaatcagatgatgagctaaacctcacacatgactatatattcaataaaagctatgacaatgccagcttataccaaatgtattacggcccattaatttcagtgaataagaccaattttacaatcaatggaaatggccatatcatcgacggaaatgaaatgggggcagaatttgattttgaaaacaataagggagaaattgtaattaatgacttgacatttaagaatttcaaccaaacagttttacaaatttacggaaagcttacattaaacaatgtcaactttacagagagctttgaatcacttgaaagcattatatttgtaagcaagggcgtcttgaatgtaaataattgcagtttttattcaaaccgcgcaaagaatatcataagcggatcccagtcaaatataaccgtaaacaattcaatcttttctggaaatggcaattatgaaagagcaatttcagccaacagatggcagctggtcatccacaattccagatttgaaaatttcactttcaagaacggtgcaataattgatttcaagggatattacctagatctagaaaactcaagtttcaataatatacattccaatttaagtggcggagcaatacttggaaaatacttccccgcctatataaaagtagctaataaaacccaataccttccatcagaccctatgataatcaaaaactgcagatttgaaaacatttcctgcctcaacgacgggggagcaattcact

SEQ ID NO: 822 - DNA, 1024 bp, Methanobrevibacter ruminantium
atggataaaaagatttttatagttagctttattctgctagctattttcacaataggggctgttggcgcttctgatgtatcagagctgacagcaaatgatttagatgataatgctttatctctaaatgatggtgaagatttgcttgctggagatgaatctggtgaatctggcaaggaatcttattttaataatgataataactataatgatgaaaatagggtaaatgcgaataatcttgattatggtgctggtgataatgatgcatctaaagacaaggtcctatctgataatgtttccgattatatctatgccactacccttagcgtatctgtcgatgacactcctcaaagccagtatcctaccgccactgtcagcttaaatgatttgagtggcaatcctgttgctgaagccagcgtttccgtcagtgtcgatggtgatgattatatgactgtaatcaccacaacagatggtacatgccctctttcacttgataactatctgtctgtaggcagtcataaggttggggcagagtattccggcgatgggacttatggaccttcaagcgcttccaccacattcaatgtattggaagaatattcctcttatctaaatacagatttgttcatatatacaggcactggcagggaagggggctatacttctgttacaggtaagctgactcatataaatcagcctatatccaatgctacaatttccctttatgtcgacgatgacttctattctaatctgaccactgataagcaaggcgaaatcgaggggatgttattcaatataagcgtaggccgtcatgagcttaggggagaatatgtaggtgatcgaggatttgaaccctcaaatgccaccaaatacttcaatgtcttgcctaaggattcagtttccagcaatattcaaatgacactgaatgcctctgatgctcaagtgggaacacaagctaatgcatatgtcttattggaaagacaatatggaggccctatggaggatgctacaatttccatcagcgttg

SEQ ID NO: 823 - DNA, 1024 bp, Methanobrevibacter ruminantium
atgatgaaaatgactaaaaagaatctttttttaattagtttaatactactaattattcttacaattggtgctgtcagcgcagctgatgatttatctgcatcatcagatctgacagttgaagattctggagaagccatagctacggctcctgaagaatctgttctgattaatgaaaataatggagattcgattgctgataaggggcttagtgatcctatctcaaatgaaactgcgaatatcgcaatagatgaaaagactacaaatgataaagctatttctgaagaggataattccatttattctaaagacaaggctaatgttcttcgtgaaaatgaaacacctgttattttgactataaatgctccaaatatctattatggtgaaaccgctaatgtaactgtttctgcaaggtatggggctgggcctttagccaacagtagcattaatcttgctcttgatggcgcagctggtgaaaatattttaatttttgatgacggtattgctcaaaagaattatactggtttagctgcaggcaatcatgctgttgtagcatcctttagcggatatggtccttatccttctgcaagtgcttcaaaaagctttgaagttttaaccccgacagtcaatatagagatagaagctaatgatatctattatggggaaagagcttatgtcactcttcatgtaacctatggaaaccagccttttgccaataatactatccaagtatctcttgatggccaaagcagtacaagttttatcgtagaggatgatggcaatattcaagtgacttattccaatttggctctaggcagtcacactgtttcagcatactttagcggatatggtccttatccatctgcaagcgcttcaaaagacttcaaggtttcaaaaaaggaaactgctgtatcattgagcgtgtccaatcctcagcttgataagggtgatgagcttcgtttcactcctagcgtaatttcaaacggattttatgttatggctaattcctattccattatggttgatg

SEQ ID NO: 824 - DNA, 1024 bp, Methanobrevibacter ruminantium
atggtgattatgaataataaaaagctttttattgttagtttgattatactaactattttgacaataggcgctgtcagtgcagctgatgatggcctggccacatcagatgagataacagtggatgattcgtcagtagccgtttctacggcttctgcagagtcagatatttatgaaactaatggagatatagttgctgactatcaaagtgattctatctcaaatgtaactgtggatgatgataatactaaagatgagataatacgctcttctcctgctaaggacaatcttcttcttgatgatgatgacgatcctggtgctgtaaatgatgatgatgaaggggatgacgatgaagactaccttgatgatatctcagtgtctatcacaaatgaatatgacgtaaccgatcaggatgcggttatagtttccatattcgttccagatgttgaagaaggagaggatggcattgaaggatattttgtcgtttgtcttgatgacgatgatgagatattcttaggtcctttcaatcatacaatcactcctgatgactatgggactgatgttacttttactgcttctgatttagagattacagaagctgcgaattattgggtacgtgttttctatgttagcgatctggctgaacctcttatcgataatgatgaggaagatggatacaatatgatttttgatggggattgtattgcaagagattacactcaattttatgtaatcgtccctccagatggcagaataagcatttttgacactagtgctatctataccgtttactgccctccaggaagtgaaggcacagtcaccttaactctaagggatgaggaggatgtagagacttcatttacccaggaaattgaagatgctgatgatgaaaatcaattatattgggatttagattatatgggattgaacactatagatgccgccggcaactatgaggtaacaatcactcttgaaaatggcactctcatttgtgaggatgatataagaattatggatcctatagaaa

SEQ ID NO: 825 - DNA, 1024 bp, Methanobrevibacter ruminantium
atgaagtttaataaaaataggggcatatctgccatatcaataattttaattctatttttaagtatttctatggcatctgctatagaaataagtgcagatgatgctgatatggattctggagacttatccgtttgtgaagtcagcacatctgattgctacggcgagactctaatcagcgctgatgcatccggtgctgattcaagtgatgaaattataatcaacgaaacaattgcagatgaaaagacagactatcgcagctcaatccttgctgatggtgagaagaaaaaccttcatgttgaagtctctaatgatgttttcacacctgataacgattatgagttcatgctctatgatgaggattttaatcaaatcggaggatatttggatatatatcttaatgatgaactaacatactctgattttaccgttgatagtagtgaaagttcttctattagcttaagtggtctagagtgcggattaaataagataactttcatatatgatgaagatgatgtttataatcgcctcaatcaaacaaaagaattttacatttatggagaaaatcctgaatttgtcatgatacctcattacgataccataacattaaatggcaattattcttctagagtatatctgaaggaatatgatgaatggggatactatgatgaggataatgagggcgatattgaacctatcgatgataaattcaatgtatacatatataaagaaaatcctggtgatgaatatgaacttgtttgggaagatgagttcgaagctaatggaaccattaatttcgatgatgccatcaaaaccactggaaactatttgattagatatgtctttaatggaagctccgattatagctatgctccatacaactcatctaacattataagatgtgtcaatgtcataaccgattttatcattaatgatacctactttattccggataagggtttcggattctcagtttatctggttgataatgccactggagacataatagataaagaatttaagctta

SEQ ID NO: 826 - DNA, 1024 bp, Methanobrevibacter ruminantium
atggcaatggtatctgcttctgatattagtgcagatgattctgtatctttagatgcagcagattcagacatcgtaagcactgattctataagtgttgactctgtaaacacatattctgcagattcagctatatcttctaatgaagataaagacaattatcacccttccaatctaaaggatgatgataataagatttcaaaaatcaattatgaacttaatgacaccgtcttttatggagatgatgtcataataaacgcaaatcttacagatatggacggaaacataatcgatgagtttttccaagttacagtttatgatgaaggcaatccattgcagtcaaacagcttgaaaggcaaggggaccatgattgttcctacagtctcattgaccgagagcagttattatgatgttgccctaagttttgcaggcaatgaggaatatgcttcctgcaatgaatttacaagctttaacgtgacttttaaggaaaattcatatcttgccatttctaattatgattcatattctaaaataaattcaactaaaataaacttcatcatatatgatgtggatgacgaatatatcaacgacacagctgacatttaccttaatggagaatattatacaagcgtccttacaaatggaaatgagaatgaagtgaccattgaaaacctccaagtgggagagaatactgttttagttaaatataacggctctaatatatataagggctcagaagactctgctaccataatgggatatgaaaaggatacctccattggaatcgatgctccagatgtccttattggaaacgatgcacggataaagattaatctaactgatgaggacggcaatattgtaaatggcagagtggatgtggaaatttacgaatactatactggtgacgacgaatcttatgttccatttaaagacgattatgtcgtgaatggagaggcaataattgttatttatcaatccaaattgcgtgcaggcgttacatatttcataagggctgattatgaaggaa

SEQ ID NO: 827 - DNA, 840 bp, Methanobrevibacter ruminantium
gtgtttattttgaaatttgaaattaaaagaagtttaatattcatttcaatattagcaatattgatcttatctattggaatggcatctgcttctgaagaaatttctgattctgtttcaactgatatagcatctgaagatgttacaagcgaaattcaaacagataatgtagaaattactaatctagatgaagactcttctttagatgatgctgatttagaaaaggatacaggcgataaagtcaaaaaggcaaagaaaagaattaatactaaaatcatctaccaaaatatgagtaccaccgctgtagttaatgaatatgatggcagaactggggaatactttaatgtaactttagtggatgaagacgacaagcctgtagttggcgaattgattcaaattggattcaacggtagaatttataatcgtaccactgattcaaacggtggagcccaacttcaaatcaaccttgcttattcaggtccttatacctttgctatctgctatttaggtgaagatacctatgaatcttcctttgaagttgcagtaattaatgttgctgctaaaaagatgactttaactgttccttccaaaagctataaggcatctgctaaaaccaaaacattaactgctaccttaaaggataataagggcaatttaattaaaagcaaacagatcagcttcactgtaaacggtaagacatacagtgcaaagaccgattccaaaggtgtagctactgttaaagtaagcctttccactaaaaagacttacagcttcacagcaaaatttgctggagacaagtcatttggtgcggttactaagactggtaaggttactattaaataa

SEQ ID NO: 828 - DNA, 1024 bp, Methanobrevibacter ruminantium
atgcaagcaattattccagttaaagacaattttctaattttagtgacaaatatgaagaaaagtgattttaaacgtatattcatatgtttagttcttcttacttgcttgattggtgcagtaagtgctgctgaagacgtttcagtcgatgatgttagcacagatgctgtagcagttgacacaatcactgaagatgcaagtgaccctacagatataagtacggtcagcgagccagtctccaatgatgttcaagcaaacacaagccaagaactaaacaaagaacccgctaccaagtctacaaatgtcttgaaagatggcacatccactaacatttatgtggcgactactggtagcgatgaaaatgacggtttaactcaatctactgctgtagctagtcttgctaaagcagttgagattgtaaatgctaccgctggtacagattttactattaatgttgcaaacggtgactataatattagcaaaatcgaaagtcctgcagctaaaaacgtaaatcttattggtgaaagcaaagaaggagcgattcttcacgcttctgatacatatggtatcaacgtttacgaagataacattgcatggactattgaaaacttgactatctgtgatttcaatagtactaccagtacaagtgcggctgtaagatgctttgctatagacagtgttttcaatataaacaactgtatattcaaaaatatcggttctaaaaacggtgctatttacataacttccactggaacaaggacaatctccaatgttcttatagaagactgtttcggtacttattcaagttcatcttccataattcacttatatggtgaaggtccagttactttggataatattgaaatacgcggttcctatatggatccttctgtaggtacagcaacatatttaaggtctgttatctatgccgaccaagctcaaaccaatgttactttaaagaattcccgaattgttgacaatatcggtgctatgggttcattgatcgaagctaaaggagcatttaaag

SEQ ID NO: 829 - DNA, 1024 bp, Methanobrevibacter ruminantium
atgaactttaaaaaacttttaatgatttcattaatcttattatttgtcttatcagtaggatttagcacagcaagcgctatagactctgataatctattagatgaaaataataatattaatgttaattatattgattctgataattcagattctattttaatttctgacaattcaaatgatgctaaatcaaataatttaatattaaataattctataaataaaaaagaattaaatgataattctaattctaattctaatttagagtgtgattcttcaatcaatgaaaatttagatttagaaaataattacaaaattaatgaaaaatctgcaggtcttaaagacaatacaaatacaatatacgtatctgtagacggaaatgatgaaaatgatggtttgactctagaaacagcagttgcaaacatatcaaaagctgtctcacttgctggagaaggatacaccatccacatatccagcggtacttatgaacaaaacaagtccacacaactgtctcatgcatttaactttattggagaggatggaacaataattaaaagaataggcacagcaaatgcctttacatacacttcagacactaaaaagacaataagctttaaaaatataatattttcttcaaccactccaaatccaagcaatccaatattaagcatggctggaggcgccgatttgcaaatagacaactgtacatttacagatgcaattgcaggtagaaacggccttatcagatatttgggatcaagtacaggaaagattacaaacaccaatttcattggattgaccggctctacaagcgcttcatccagctatatcactgcacttgcccaatctaaggtaaaggttgagaattgtacctttgcaaatatcaatgaaccaggctttttaaattcacttgtttatgtcaataacaatgagactaatttaacattggtcaactgtgtttttaataatataaccggcaatttgaatgctgttgttaataatagagggtatatgcagattaaaaatt

SEQ ID NO: 830 - DNA, 1024 bp, Methanobrevibacter ruminantium
atgtttctaataggtgcagcaagtgcagcagatgatgctgttactcttgaaggggatgctgcagctgttgattcaattagtgaagatgctagcgctcctataactactacggttagtgaagatgctagcataggtactacttttagtgatagcgctatcgaaagcgattctattcaatctaatgatgatctggaactaaagaatgtaactgacgttaaacaaaaggattcctctgatgctttaaaagacggagaatccactactatttttgtatccactgggggtaatgacaataatgacggcttaagtttggaaactgctgttgccactgttgaaaaagcaatcaatataacaaaaactggtggaactgatttcaccctcttgatttcaaacggtgattataacattgaacaaatcaccatccctgtcggcaaatatatttctattattggtgaaagcaaggagggcacaattcttcatgcttccggcgattatggatttgacatttcatacggatgtaattttgaaaacctgaccatatctgacttaaacagcacttcctctacaagtgctgccataaggattattatggataattatgatattaatataaataactgcatatttaaaaacattggttctgcttatggggcggttcatgtttattccaatggaaaaacctccatttccaatgttcttatagaagactgctttgctaccaaatcagatgactcttccataatccatgtttctggaaaaggtccggttagtttggataatgttgaaataagaggctcttatatgctgcctcctgcttttccatggagtaccccttatttgggagccattatctttttaagcagcgctgatcctgatgtgactctaatgaattcaagaattcatgataataatggttctatttattccataatcacatctaaagggaaaattaaaattatcaacactacaatttccgataactgccttaacgcttcatatgcaagcatattttccagtggagtaa

SEQ ID NO: 831 - DNA, 1024 bp, Methanobrevibacter ruminantium
atgaaaattaaaaagagttttgtcattttatgcttaattatctgtttatttactattgcaagtgttgcagctagtgatataaatgatacaaccataagtgatggtgacaatctaatcaaagaggcagatggggacttattaagccttgaagatgataataatctaaaagaattaaatgaagagtcagataaaaatttactagtccaagaatctgataatgataataataatccagagtcagataaagatttactagttcaagaatctgataatgataataataatctagaatctgatgagggcttattagtacaagaatctgatgatgatttaaataaaaaagcagacggtagtttgtttagctcaaaatacggagataacgctgctcctataaaaattaacactagctacctaataaaagaaataaacagctacctcgagaaagacaactacactgccctaaaggaagaaataaacaactacctgaagaaaagcaataacaatgccataaaagaggaaataagcaagtatatcttgaaaaatagctataaggccttacaaaaagaaataaacaactatctagaggaaaacaatttcagcaccctaataaaagaaattaacaactatctagaggaaaacaactacccttccatcgaggatggaattaaaagctatcttcaatcaaacaattacagctctcttcaagatgtccttagcgatgtaataagcaagataataaattcatctaaaaaagaatcagagccaattgacgatggaacttttaccgctttgcagtataaaatcaattctgccccaaatggcgctacaataagcctagataaggattatagctatgatgaaggattcagcacaagaggcattgaaatcaagaaaagcattacaatcaatggaaacggacacaccataaacggactgtccgcatcaaggatctttctcattcattttggattgactggaaacaataaggtcacattaaacaatatagtattcgccaatggaaaga

SEQ ID NO: 832 - DNA, 204 bp, Methanobrevibacter ruminantium
gtgactgtttcagtttttataagtgcttcatttgcttttggcaatgttctaagcaatgcagataacggatctgtgcaaacttacaatagtcataaggatatttcctctccaaatatggattataagcatcctggtgaacttatttatgggggctgtggtggaaatcaaaatattcaaaccgatgggcatatttgcgagaaataa

SEQ ID NO: 833 - DNA, 1024 bp, Methanobrevibacter ruminantium
atgaaggtcttaaagatagcaattatcatgcttattttaatcatatctctgggagcggtttcagcaacagagaattttaataatgatttaagtgataatggactaaacgataacacattaagcgacaacagcttaaatgaaaataccttaagcgacaacactttaagtgataaaagcttaagcgaaagcacaatcatccaaaatgatcatgataatttaaaagatacaaataataatgataataataaagctctaaaagatcctgcgaagacatttacagacttacaaatggaaataataaatgcaagtgaccttttagaattgacagacgactataaatacaacaatgaaactgacaatatcacattaacaatctctaaaagcaatttcgtaattaacggaaatggccatacaatagacggagacaatcaatgtggcattttccaaatcaacggaactaacataaccctaaaaaatctcaatataataaatgcaaactctacaaaggacagcgccctattactcaacccaggctctgagcttgagacaaacaatgtaaccttcatcaacgacagctcagacaaaagagtaatatttgcatttggagcaaaatatacaagcaataatgataagtttatagactgcacatccctcaatgatggagtaataaactcataccttggtgaaataactatcaacaacggatattttgaaagctccaagccattggactgggctttcgtcaacagtttgggaaattcctcaatctacgttttaaacacaacatttgcaaataccacctccaaatacgctacagcaatcaagggagatcgagaaacagtaattcatgattctaaattcattaatctctatgcaaaccttactgcaggagcaataggattaaaaagaattgaagaggctgaaattgacaattgcacattcattaatgtgagttcacaaaaaaatggaggggcaatattccttgacatatattcagatagcgaagacgtaccaataatgattt

SEQ ID NO: 834 - DNA, 1024 bp, Methanobrevibacter ruminantium
atgaattttaaaacaaaaggaagcttgattcttatttcattacttttcattttaataataggtattggaatggcatcagcatccgaagatataaatacagatatagacacggattatcaatctgatagcattgatgtgtctgatgtaagtttaaatgatgaacagatagcatctgaggatagtttgcctaactatgaaattgcaaataaatccaaggacaaactatatgatgaaggagaagaagaggaaggcggcataacaaatgacgatgatgatgaaaattatagaattgatggaatctatgcagattatacaattacaccgtctgaaaatggaactatctttgttgaaggagaaagaatacaaataatatttaattttacagatcaagactatgagcctgtttccggagactggtttattaatttttatggtgaaagtacagatgtcgacatatatcatccatttgaagcaaccgggctcaccgactatgtcgttccaatttatttgcctccaggagactatgtcatattcttttatgaaggcgtggtttttgatgattttggtggaatagaagatgaaggaactcaattagatgtaacttttgaagatgcagaaggaaaccaattagataatccggaattctctatcagaaccaactacaacaaaaaggtatatgcaaatcttaccatagactacagtgtagcagaacttgaaaatctagtggaaggagacgatataactgcaaaaataagcttaatggatgaattcaataacaaaatgactgaaaaggttaacctagagatttacaggaatggagaaaactatgattctaaaaaggtaaacgttgtagagggccaaaataacaacatcatctttgaaaaccttcaggaaggaaactattcattggaagttgcaagcattgacagcgttccaaaatacactaacatcataacaaaagcagtcaacttcacagtcaaaagcaactatgacccagacaactaccaaatcatcctcaatccag

SEQ ID NO: 835 - DNA, 621 bp, Methanobrevibacter ruminantium
atgggaaaatttaaatttatatttattctagttttagctctatttttaatatgtggaattgctgcagttgtagatgcgcctgattcctttgatggctctttaaatcttatacctgtttctgattctagtgtaagtcagtctgattcatcagtaaatcagtctgattgtgaaaatgggacttgttcagttgacttaaacaaatctgaggataattcttctaaagaaacttcagatgatgaaattgattatgattcaaagtattatgacgattctttgattgatggattgtatttctgcaatgacctagagcatgcatttaaggatgctaaacaacatcataagaatgtgatgatcatttttgacggagcagcctgcatttactgcgaatatcttaaggatgaaggattgacagattcagatattcaaaaggaaataaatgagaatgatatcctacttatgacttataccagcgatagcccagagctttctcaaaaattggagatttatggaactccaacaactgtaatatttgatgaaaatggaactgagttaggaagaatcgagggctatgagtctccagagcaattcttaagtgaactgaaagagtataatggcaaataa

SEQ ID NO: 836 - DNA, 825 bp, Methanobrevibacter ruminantium
atggattctaagaaaatattaatgattgctgtagttgctttaatagcaattgttgctgtaagttcatgctctgcaggtttccttgactttttaggaggagacaacgctactgacgacagtttaaatggaaaagaagttaatttagctgcagcagcaagtctaaaaaatgtatatgatgatgaattgattccaatgtttgaagcaaaatatcctggagtaaaagtaactccaacttacgcttcaagtggtgacttacaaactcaaattgaaaacggtttagaaacagacgtattcatgtctgcttccaacaaacaaatgaacgctttagctgatgaaggtttaatcgacaatgacaccaaccttcaattcttagaaaataaagttgttttaatcgtacctaaagattcagacttaaacatcacatcattcgatgacttaaaagatgtgaaaggtaccattgctattggtgacccagaatctgtacctgcaggacaatatgctaaagaagcattaaccaacctcggtatttgggacgctgttgaatctaaattctctttaggaactgatgtaactgctgtattgaaccaagtagctcaaggatctgctgaatgtggtattgtatatgctactgacgctaaatccaatgatgatgtaaaagtggtttgtgaagctcctgaaaactctttaaacacttcagttatttatcctgtagctatgattaaagacgctaaagatgcagatgcagcaaaagcattccttgaattcttacaaacccaagaagctaaagacaaatttgttgaatacggatttaccattcacgaataa

SEQ ID NO: 837 - DNA, 1024 bp, Methanobrevibacter ruminantium
atgaagttaaaatcaaagtattttgtatttttactcataatatgtatcctattcagtatttcaacagtttcagcgaatgataatgatatgagtataaatcaaaatctgcaaaatgatgcaaatcaagatataaatcaagatttgcaattaaatgaagcatatcaatcagatacaaatctaaaccaaaatttgcaggcaaataatcaagaaaatgatttgctaaaagcatctgaagataagacctataatgatctctataatgacataaaaaactgcgaagatacgttcaatatagaaaacgactataaatacactgaaagcgataaccacacctttataagcataaataaaaccaatctagtgataaacggaaataaccatgtcattgatggatccaataaagctggaggatttgaatttttaaaggaatcactaaatataatcatcaatgacttaactttcattaactgcaacgattacaccatagttaatgaagacggaggaaatatcagtttaaataatgtcaatttcactaacaatcacaataaattgggcattttgtattcagagggaatgatatcagttttcaatggagcattaactataaataactgtaatttcgattcaaacaataatactaacctcatatacacaaattttgcagagctaagaattacaaattcaaatttctccaacggaaaagggattggaagccctatttatgccaataggttcgaattgtatatagataactgcagctttgaaaatttcactgccccctatggaggagcaataaatttcaaaggaaacacctttgtcattaaaaattcaaaattcaagaacttgaatgccgaaataactgcaggagcaatttttgcaaagtatttcccaaaaacaaataaagatggcccctatattccgggtgaagacatgctttttgagaattgtgaattttccaatgtctcatcaactcataacggaggtgcaatctacttgaatctggattcaagttctgagggctttg

SEQ ID NO: 838 - DNA, 126 bp, Methanobrevibacter ruminantium
atgaattattccattattatcttcattatctttcttatggatgcattggtgttaatggctagcatacaagtctgtggagcttgtggaaagggttcaaatcccttatgtgtccctatggtaatgtga

SEQ ID NO: 839 - DNA, 798 bp, Methanobrevibacter ruminantium
atgaagtttaattcaagagttttagggattttatctctattatttgttcttacaattcttgtttcaagtgtgggggcagcagaatataaattaacagaaaaagattttaataatacctttaaaataggtattccagaaggtacagacttccagcaagatgcatattcaaatattgctgctggtaatgttaactttgcaatgaaagtttttgacaatattggaaataatactgatggtgttgtttctgtattgtactttaaggactcttcttctgattcaaatcttatttccgatgtgattgatgatttaaatagcagtggggaagttgttgaagaaaatgacaattacatcatagttaagaataattatgatgctgaatggaatgctccagatgccagcacatcttcagatgagttctggagctttatcggtgatttatgctcctctggctctgatatgaactttggagatggtgattcaaatatccatctttccgatgatggagttaacatagaagattctagtgcaaatgtatcattttccaaaaatggaatctatgtttctgattccgatggtcagaatgtttccataagttctgaaggagtaaaagtctctggcgggtcttccaatgagacagtggacgtaaatgctgatgtggattcagtcatgaattcatattctgaatttgcagactattctctttgcttaaagaatcctaaaaaagatcaattgattattatttgtggtaatgatttagatctattaaagcaaatggcagactctgcttctttcaaatag

SEQ ID NO: 840 - DNA, 1024 bp, Methanobrevibacter ruminantium
ttgtcaaatattgaaactgatgattcatttattagtgaaaattcaatatcaagcgatattaatgataattcattaattaatgaattcacagcatcaaatcaaatcaacgacaatatagcaattaatgatggcttaagcaaaggcgacaaaagccaattatctgaatccaaatcaatatacgtatccacaaacggcagtgacgattcaggagacggaagtgaaaaaagcccataccaaagcataaaacatgcagtatccaaggcagatgatgattcaatcatatacctatccagcggaacttacaatggagagaataaccaaaacataagcataggaaaaagcttaagcatctatggagaagattccactataatcgacggtgaagacaaggcacagctattcatcatgaattccagcgcaaaattaagcttaaacggacttattttaacaaatgcatataaggacggcaacctaagcgactatggaggagccatcataaatgaaggcggacaattgaccataatcaactctacaatcaaaaactcttatggaaactactatggaggagccatctacaacaatttaggaagattgaccatcataaactcaagcattttaaacaatagcgcaatacaatatggaggagccatctatacacttggagtgacaaacatccagaactcagttttcgagaaaaacaccctaacagctgaaaaaggtgtgggagcaagcatagcagcaggaggaacaataaccctcaacaatacagatttcctcaataatcatgcgatatattcagcagcagcgcttctcagcttaggaaacgcaacaatcaacaactgcagtttcataaaccagaccacaaactatacagcaggggcaataagcaatcacggaaacatgtttataaacaacagccttttcttcaattgcagagtaagattctatgcaggagcaatacttgcacctccaagcggacaccatgtcgtaacagaggtctacaatacaatctttgactataaca

SEQ ID NO: 841 - DNA, 1024 bp, Methanobrevibacter ruminantium
atggaaaagaaaactacaattatattggttattttaattgctcttattgcatgcggtgttggaataactttattcgcttcaccatcatctatttctacagatgggaataccacaataactgatatggcaaataggactgtaaatatttcaagtagtgttgatagggtggttgctacaagtccacctatgaccactatcgtttatatgctggcacctgaaaaattggttggtgtaaacttccaatggactgatgaggaactaaaatatgttccggatcagtataaggataaattcccagttatcggtggatggtttggaagtcaagacggtaattatgaagagtttattgcttctgagcctaatttggttattgaaggtattgatgaaggaatgggtgttgacctatcaactgttgaagaaagacaggagaagtttggttcacttcctgtagtggctgtaactgacaatacaaatgttacaaagatagacaatacgatagagttcttaggcaagcttttaggtgctgaagataaggcaaatgagttaattgcttttaatgataagtatttgtctcaagttcaatccactgcaagcagcattccagattctgagaaaaaatctgtttattatgcttctggtgaggatggattatccacttatgcaagtggcgcttcacatggtcaattgatttctcttgttggaggcaaaaacgtagcagacactgaagttaaggatagcggaagtgaattgactgtttccattgaacaggtaatgtcttggaatcctgatgttattatagccacagatgaggacttttataataaggtttataatgattccaaatgggctagcgtaaaggcagttaaggaccatagagtatatctttctccacagtctccatttaagtggtttgataggccaccaggtgctaatataattataggagttccttggactgctaaggttatttatccagataaatattccaatatagatatggttggagctactaaagagttttata

SEQ ID NO: 842 - DNA, 1024 bp, Methanobrevibacter ruminantium
atgaagaataagagtttaatattaatttctttattattactgattacaataataagcataggatctgttgttgcaacggataatgaagaaattaatatggataatataaataatattgataataatgaggatatcgctaatattgataatgtcgataatgtcgataactccaatataaacaatccaactgacataagaatagacaattcaaacctaaatagagaaacagaactagattcaaatttaaataaatctaatcagattagggaagacgaattagaacaaagcaatgcaaaatccaatctaaaatcaagcaagctatcctccacaatcactgtagacggctcagatgaaaaccaaatgtctaatccaaccattcaaagcgctatagacagtgcaaatgctggagatacaatcataataaccggaaagtcatatgttcactgccatttcatagttaacaagccactgacaataataagcgagattggaacatcaatgagcccatgcccttcaaatacaaaaggctctggtgcacatggaatattctacataagccctgaagctagcggaacagtcctaaagggattcaatctaacaaacacatatggtgactatgacgactatggaatactcataagaggagcagagaatgtagaaataatcaactgtacaatcaatacagtcagcgacggtgacggaataagaatagaaaatgccacaaacacaaaaatagctgactgcctaattaaggattcaaacattggaataaacattacaggttcaagcaaaacaaccgtaacaaacaataacataacaaacaacaaggtcacaggtgtcaatgtaggaataaataacaacgatacaactattcacactaacaatatcacatataaccagcatagcggaatagacctctactctggagattatgtatacatcctaaacaacttcattggtcacaatcaaaattctaaaagctcaagcggagctggaatatatgttaactcaaatatcaccaaag

SEQ ID NO: 843 - DNA, 105 bp, Methanobrevibacter ruminantium
atgagaagcactatcctgttaagtgcaagtactgcggaaagccgttcaccaagtctcacaacaggcagatgtactgttcagacagttgcagacggaatgccttga

SEQ ID NO: 844 - DNA, 387 bp, Methanobrevibacter ruminantium
gtgcttctcatttgctttataggattggttgaggcgatactgatggcattggttgattgggaggacttggcaatatccgttcgcaagtctcctagaaagctttataatgttttgaaggatgagttaggtcttcctgaatggaacgaactgtctgtgattgaaaggagaagcatgaagaaaaggtatgctgtcataagagattcctttcctgagttgcctccatgggaagaactttccgtcatagacaggagaagccacaagagactctacaaacttatcaaatcagtttatgatggagactatgatgacagtccaagcttggaaggtccaccagcagcagtcggtcctcagaaggagattccattggaagaggcagagtatccttga

SEQ ID NO: 845 - DNA, 1024 bp, Methanobrevibacter ruminantium
atgaataaaaaaattatcttatccctccttttagtattattagtagctatttctgtctctgcagttgcagcagcagatgctgatgtcacatatataaacgatgctgcagatgtagacgatgttgcagacgaaaaagttgctcctcttacagctagtgctgatgcacaagacatccaaactaagcttgataatgctaaacctggagacacaattgaattagaaaacaagacatatgacgttgatacaacatttaatgtaactaaacaagttaccatcaaaggtcaagacactgtcattaaagctagcggtgcatcccaaggtggtagcggagcactcttcattgcaaatgaagctggaactgcttttgaaggaattaccttcattaacactgacggccacaaaaactatggagaacaagtatcaggatatgctatccaattagctattgaaaacggtactgtagacaactgtaaattcatcgactggagtagcggtgtatacggtaaaggcgcatctttctgtagcattaccaactcttacttcaacggttcatccgaacaagtaaccaacggcggtaaaaaagaatacggtactaaagcaattaaccttatgggttcccacgacattaccgtaaccggatgtacctttgaaggacaagttcttgacgctatttccattgcaagtaactcaggtaacaacatcatgaccgacaacactttcatcgacaactgttatgctatctacttcggtggagcttccacccaaggatgtgtaatcgctaacaacagtttcatcagatgcggatactgtgttgatgacaaaggaaacgtaatctttaaagatttacctataatcagtactcaaaaagcagctaacggatacatcattgctgataacactattgaagcaaatgaaggatctatctttatgaaagctgaatcaggtaacacagcacacggatacccaagtaagatcggtgacataaacattacaggcaacaccattaccgcaactgcaggggcta

SEQ ID NO: 846 - DNA, 1024 bp, Methanobrevibacter ruminantium
atgtcgttatccatatttgttctggttataggaggtggatttattaataaaagaatattattaatattcgtatttctaatattcttcataagtattggatctgtagttgcaaatgatttagattcaaattcagtcaatcaagacaattatatttctgatgtagattcttttgatggttctaattcggttttgtccagttctaatttggatagttctattgataaggataattatttaaatttagattctaataataatttaaatttagattctgataagaattctgtttcaggttctgatttgaatttaaataatgctgatttaattaattctgtttcaggttctgatttgaatttaaataatgctgatttaattaataattcaactactaatgattcaagcaattcaaataattcaaataatttagaaaatcttactaatttagatgattctaaaggtgcttctaatcaaaagcctcaaaagtatcttattcctaatgacagttctataggttctgcatatatccaaaagatcattgataatgctgcacctggaagtacaattcaatttacaggttccttctataaaaatatttatctgaaaatagataaagctctaaacattataagtaaatctggcactgtgataaattcaagctatcgtttgcctgtatttactatatcaagaggaggatctggaacaaatatttcaggttttacagcaaatcttgcaaattcctttgtagaggcaagtgatgtgtccgatataagcatatcaaaaaataaaatctttacaaaacggaaagctattgtcctcgaaaatgtttttaattcaaagattgtaaggaatagtttcctaagatttgaaactgccattgacatttcaaaatctggcggattgaccatatccaataataatataactccagataacggatacaatgtgggaattagcttaaaagacatttatagagacaaggttagcatattaaacaataatatcactggccatgacagacgtatag

SEQ ID NO: 847 - DNA, 1024 bp, Methanobrevibacter ruminantium
atgaacaataaaaagattataatgtcttttctattggtcctattgattgcaatatctgtctctgcagtttcagcagcagacattatagcagacaatcaagattcaatttcatccaatgacaattcaatcaatgaaattgctacagaagacattagcaaagacattaatgacaaatctctttcagatggagtcagcaccggcggaaacaattggattgtaaaaccatcaacagatggaaaaagcgatgcaaattccattcaaaaggcaataaacctcgataatacaaagcctggagacagtctccttttaactgataagaacttcaccttagaaaagtcagttagcttgaataaagaccttacaatcaatgggggaaatatatacaatcagaacaatttaactgatctatttataatagatcctaaatctgaaggaggtccaaagaatataacaattaccaatgttacattttatgtaaatggaaatgaaaacattgtgcttgcaaatggagagaattacggcacaacttatattgatcttgccaatataaaaataagcaactgtacaatcttgcctataaatccagacagcaatatcaatgatacagtgcttcttaatataaaatccgataggacagtaggccaaacaggtcaaagtacaggattcgtattggtttcaggcaacaagctaaacggcataaacacccttaagaataacgattacgtattaaaagacgactttgttattcaaaaggcggaccctatcttaaataccgccctaatatgccctaacatgactattacaacctatgataaaaacactaatgacactccaagctattatgaagtgaaattgatagatcaaaatgtcaatcctgtaatcaacaggacaattcagataggattcaatggcaaaatctatgataggacaagcgatgaaaatggaatagcaaaggtaaaattaaccttagcttacacttcagtttacacatttgcagtttacttcctaggtgatgaaagctatg

SEQ ID NO: 848 - DNA, 1024 bp, Methanobrevibacter ruminantium
gtgaataacagtgctgataacggtgccatctatttcaataatcaaaactttggtcaaaatttaacaatcaatcataatattttcctgaacaatgatgccgttgcaatctattttgtgagaaatgattccgcttccaatgcagattacaactggtttggaaataatgcaactaattgcgatatagcgccaacaagcaataatatggaaatgaatacttggctgttcttgaatgctacatcagaaccggaaggaatttctattcttgattcatgcgacattatatttaaattatatgcttatgctccttctggagtatcagaatatgatagcagccgtttgaaagagattaacttaacagtgactccaactaacggaaggatcaatactacccaagccaaactgggagaaaaggttcactacactccagagagtgccgaatgcatgctaacagcatcaatagaaaatgccttctacactacaagattaaaaatctcagatggaacaacattccgtgacttgaacaatctcataaaccgcaacgataatgacactattattttggataatgatttcatctataactcactttttgacagtaaatttaaaaatggaataaatattaatcgacctttgacaattgttggaaataattataccatagatgctaccggaatggcaagaatattccgtattcaagcagatgatgtagaaatcaataacattacattcgctaatgctaaaatagacggcaatggtggtgctatctattggtattccggcgctagaggtattgtttctgattgcagttttgtaaataattcagctaagatgtatggagctgctatctattggaatggtgctaatggtaatgtttctgattgcagttttgtgaatagcactgttactgatgaacatggtggtgctatctattggcacggtgccaatggagttgtttctgattgcagttttgtgaacaattctgctaagaaatatggtggtgctatcttttggaacgctgccaatg

SEQ ID NO: 849 - DNA, 1024 bp, Methanobrevibacter ruminantium
atggccggatcaactattcgagcatttaaagtaactgcttccggtgtaacaattaaaaacctaaccattaaaaacgccaatgtaactacagatgatctaggcaatacagatgatgagggcgctgcgattgactttgaaaagtccggtaccattgaatattgtaattttattaataactctgcaaacgctgccggtgcagtatacttttataaagataacagcaaagcaataaattgtaatttcagctataaccaagcggtatactctggtggtgcagtttgctttgaggaaagtggtactatagaaaattgtacttttgtcaataacactgctgtttatgatattttaggaggaggcggtgctgtttgctttaatggtacaggtaatgcgataaattgtaactttaccaataacaccgctcaagggtatttttcatgggctggtgcaatttgctttaatacaaatggtaatgcgataaattgtactttcactaataataaggctcatgactctggaggtgcaattgagatttatggcaatggtaaattggaaaattgcagttttgataagaattctgccaacgatggtggtgcagtcaagatttatggagctactaagatatcaaattgtaattttactgaaaacaaagcagcagaactttcaggtgatggcggcgctatctattggaatgccagcgctggcaaattagaaaattgcagttttgctaaaaactcagcttttcacggaggtgcagtttcctttgaggaagatggcgaagtaacaaattgtaattttactgataacctagcaggagacagcggtgcaatttggtttacagcggatggtactgtagaaaattccacttttattaagaatgaagcatgggatgagtatggcggcggaattgtcttttatacctccggggatgtaagaaattgtaatttcactgataatgaggctgataagcaaggtggtgcagtttactttaatggagcaggtactgtagaaaattctaatttcacca

SEQ ID NO: 850 - DNA, 228 bp, Methanobrevibacter ruminantium
atgaaaatccaaagaggtatatatataatattaactttacttgttctctttagcctttctgctgcaagcgcagcagacgatcttacagatgatattattagtgctgatgagaatgaagaacttattttagatgaaacagtcattgatgacgtttcaaatgcaaatgacaactatgatgaagaacttattaaagcaaatgatgaaaaatttgtatatgcctggaaatga

SEQ ID NO: 851 - DNA, 231 bp, Methanobrevibacter ruminantium; identical to SEQ ID NO: 728

SEQ ID NO: 852 - DNA, 714 bp, Methanobrevibacter ruminantium
atgaatcgaagatcaaagttaataattgcgattttaatagttatcataataggtattgccgttattcttttcggcagtatgtttggtggtgaaaaattatcatcaggtgataaagacattttagtttgtgcaattgacgaaagtgagcctcgaccaggaatgggggcagttgatatggcctttttagtacatatgaatgatggaggaattactaattatactccgatttatccgcatggaatggtccatccgtctatagccgaaccggaagagtatcaggctatgggtgcaggggaaaaactgctcttgcacgattgcttctattgggaagacaaacagcagtgcatgcaatatgcaaaggagattcttgaatataatacaaattattcctgtgatgcagttattgcagttaacagtcaggccattgataacatcatctcagctgcaggtaccttaaagtataacggtgaggaagtcaatgcatccggtattgatttcatcagggaagagcagaataccatgggaatgaccagaggagactctgtaatggttattgtaaatgcattgatgcaagcggctaaagaccctgataaaagggataagatgattaatgctgctgtaagcgaatatacagccggaaatattgcaatgtatcctgaagggtcttttatggaattgctcgcttctaaaggcttgcaagccatgtttgggtaa

SEQ ID NO: 853 - DNA, 717 bp, Methanobrevibacter ruminantium
atgaaaagatcaaaaaaattaattatagcaattcttgttgtaatccttttgggattactattggcaattgcaggatacttcgttggtggtcctgacttgtcacaagaaaataaaaccattttagtcttagctgctgataaatacgagcaacctaatggtggttgtgatatggcatacctagttcgtttagaaaatggtagtttagctaattacactcctgtttatcctggtggaatgtatcacccttcacaatcagctcctggaaaccttcagggcaatatgctgcttcacgattgtctgtggaacggagttgaagacggtatgcaatatgctaaggagattgtggcattccataccggcgttgaagctgatgctgttgtagtcctttatgacgagggagtggacaatgtattggattccatcagacctattgagattgatggagagccaaccaacctaagcgcaactgacatcattcgtgaaaacgataattatgcaggttataagggtaacgaaggtgtaaccggaaccatgtctagggcagatgctgttatggtattggttaaagcggtttccaaacaagctaaagatcctgctaaaaagagcgccatgttgcatgcagctttagatgagtacactaaaggaaatattgtaatgactcctaaaggttctttcactcgtttgcttgctacaaaaggattggaaagctttgcatag

SEQ ID NO: 854 - DNA, 1024 bp, Methanobrevibacter ruminantium
atgaaagaatacaagatagcaattataggaggagggccagcaggaatgatagctgcaataagagccgcagaaatattaggcccaaatgcagtatgcattctagagaagaatgaaagcttaggaaaaaagcttcttttaacaggaggaggccgttgcaacataacaaacaacactccaatccacgatcagcttaactattacaataaaaacaaaaacttcctaaagcactcattatacacacttccacaagacaagctacttgccatctttgaagagaaagaccttgaatttcaccaagaggacaataaaagggtcttcccagacagcgaagatgcccatgacatactggacattttagaggaatatcttgaagagttaggggtagatgtgtataacaatactccaataaatgctcaagacatagagcatgaattaaatgaaaggatggaaccggtatttgaaatagaaaatgaaaagatatcattaaatgcatcaaagattatagtatctacaggaggcatcacctatccaaatacaggttccgatggagatggatataaaatagcatctcacatgaatcatacaattacagacatcaagccgggacttgtctcattcaatattgatgactttctgcttaagaccttatccggactcactttagagaatgttgaagtctcatttaaggataagaagaaaaagatatctgtaaaaggggatatcttgattagccactttggccttacaggccctgcaattattgatttgtccaacagattgcttgaaaaatccgatttaactgtccttgacgacaagttaaacctaaagagcagagatgaaatagaggaattggaactctttacaaacaggattacaatcgactttactccagatctaacagaggaagatataaagaaccagataacaaaggacagcccgaagaatggaaagatggcaataaagaactatatgaagaaataccttccaaataactttattgattatttcctaatgaagatagaca

SEQ ID NO: 855 - DNA, 306 bp, Methanobrevibacter ruminantium
atggcaaatgaaggtggaggacatttaaagactattttgatgattataatcttaatagcttttatttgtggtcttgcattaggagtttcagttataatgggaggggatgataactctcaaactgaatctgaaggtgtgcactatgttaatgtgacaaaaaacattactgaatataatgaaagcgggaatcttattgaaaccgaagatggcacacatatagaattttcttcttacagcgacaatgtaactgaaggagaaaacgttacagcctataattcttcaacagatgcagggaatttgttttaa

SEQ ID NO: 856 - DNA, 390 bp, Methanobrevibacter ruminantium
atggataataaaatcaaagcaggcattgcacttgcaataatcgttttagtggctgtcattggcttttcattcattaatgaaagcaataatgttgtaaatcaactgtctccgcttactgaaagttttgactattccatggaacctatgacaacttgggatgattctaaaaaggaatattcctttaatcagaacatcagcagtgcaaacggtaaagactataaggacatcaccatcgatatattgatgtataacgatggaaaatccttagataagcataccagcactataaatagcactaaagacggttcattcaatttaaaattcactcaaaggctcgaaggagaacctgatgaattttattataatgtgacaaaggctactgaaatataa

SEQ ID NO: 857 - DNA, 1024 bp, Methanobrevibacter ruminantium
atgtttaaagtaagcaaaagcatattaatcgtttgtttagtatcccttttcctattagtttcacaagctagcgctgcagactctaatggcttaagcataagagatattaattcagttgatgaaaactacaatcttgatgccagttatcttgactccctccaagattcaaatggcatgcattcagattcctctctaaactctaatggcttagatgataagtcaaactatgacaagacttcaataagtcagaatcaaacctcctctaacttaaaagacaatgatttagataataatgatggagaaagcgagattattgaagaggaagctaaagacaccgaaggtgtagtgatggctggagacagctacagctgcggacccgcatcccttgcaactgcattaaacaggcttggcttaaaccttagcctatctgaagtatcccagcataccaacaccagcaaggatggaaccaatatgcaatccttaatcgatgctgcaggatactacaatttctctgcagttggagttgaaatccaatctaaagacttagctgaaaactccatagtccatttggatattgatggagcagaacactggactgtagtaagcaaagtaactgaagaaagtgtctttttagctgactcaacaaggggaaacatcaatatgagcattgatgaattcaactccctctttagcggaaaggcaatcctattatctgaattgaacaaaaccaatgtttcaaatgtgatatccaacaaaaacattaaggttttagatcaatcccaatgcttaaacgttaaaggaaaaggatgggttagagtgcttgtaggttataagaccgaatggagatacggcttaatcaacacctattcatgggtgctaagaccaaaagtcatcaatggacatgtatcctattctgcatgggaatatgtaaaggtaaaacatcttagttggggaaaatataaggtcaaagtacctatctacaaatacaagtacatcaaaaaccaatatgaggtaaaaggaaaga

SEQ ID NO: 858 - DNA, 1024 bp, Methanobrevibacter ruminantium
atgtggtatgatatgaaaagaagaaggttttatttaatattatttataattctattgattttagcagctatagcaatcataggaacattttcaagcttcagtgatgtttccggatatgatttgggaagtgatgacctatccattgccgttacaggggatgtgatgttcggtcgtaagatgccgggagtcctagattccggagcaagcccattcaggaatgttgaaaatgttacaaagtctgcagacattttgcttgtaaactttgaaaacccggctacatattccaccaatccagtgaaaggggacgttcctttaaaggcagaccctaaatatgtgcatctgcttgctgaggccaatgagattgtcattgcatctcaggacaataaccatgcattggattatggggatgaaggattgaacgacagcatcaaaaaccttaaggatgcaggaatctatgtgataggagctggaaacaatctctctgaggcatctaaacctgtagtcatagaaaagggagatagaaaggtaactgttttaaactatatggatgcggataactttgcagaatatgcaagcatcatgcctccggcaactgcaaactcatcaggattctgcgcatatgacagcgagcttgcaagaaaacaagtggctgaggctcgcgagaacgaatccagcatagtcattgcctatatgcattatggaaacgagtatagcagaagccctaatgagtatcagataaacatgtcccatgagctgattgacagcggtgcggatattgtgataggttcccatgcccatgtgactcagggagtggagatgtatcatggcaagcctattttctataatttaggtaatttcatattcgatcagtccaatccagcaacccataggtcttatttccttaacttggatcttcatggtgacaattgtacagtgactctctatccgactgtgatagttggctacttgcctcaattcatggatgctgattcagctaaggcattattggcagagttgtatcctc

SEQ ID NO: 859 - DNA, 1024 bp, Methanobrevibacter ruminantium
atgaaaattacagttgcgggtgtaggatatgtagggctttcacttgctgttctgctcgctcaaaaacatgatgttacagctattacaacaaccgaatcaaaggcagaaatgctaaatcagttcataagtcccattcaggacgatgagatagaaagattctttaaggaggttcgtgaaggagagagaacccttaatctccatacaacaactgataaggctgccgcttatggggatgcggatcttgttatcatagccactcctacaaactatgacgatgtaggcaatttctttgacacctctgctgttgaggacgctatcgaatggacccttaaggtaaatcctgatgtccttatggtcataaagtcaacaatacctgtaggatatacagaatctgtccgtgagaagtatggaattagaaacatcatcttcagcccggaattccttcgtgagtcaaaggctctctatgacaacctccatccaagcagaattgttgtaggctgtgatgacgaccagatggaagagggtcagatgtttgcagatctacttcttgaaggcgctagagaagaggagaaaagagcaaactctcttgaacaggacattccaatattgcttacacacctaacagaatctgaagctatcaagctgtttgcaaacacttaccttgctgtaagggttagctacttcaatgagcttgacacatatgcccagaccaaaggccttgacacacagatgattattgacggagtgtgcatggaccctcgtatcggaggccattacaacaacccatccttcggatatggaggatactgcttgcctaaggatacaaaacagctcttggcaaattataaggatgttcctcaaaccatgattgaagcagttgttcattctaattcagttagaaaggaatttattgcaaatcagattatttcaaggaatccaaagacagttggggtctatagacttacaatgaagagtaacagtgacaatttccgtgcatctgcaatacaagatgtgatgaaaagta

SEQ ID NO: 860 - DNA, 1024 bp, Methanobrevibacter ruminantium
atgaatttgatgaaaattacagttgcgggagtgggatatgtagggctttctattgctattctgcttgcccagaaacatgatgtaaccgcaattacaactactgaatcaaaggcagaaaaacttaaccaattcataagtcccatcagagatgatgagattgagaggttttttaaggagactcgtgatggaaaaaggaaattaaaccttcacacaactactgataaagaatctgcatataaaaatgcggatcttgtcattatagcagcaccgacaaactatgatgatgtcaaccatttttttgacacatcagctgttgaagatgccatagaatggactctcaaggtcaatccagatgttttgatggtcattaagtcaacaatacctgtgggatatagcgagtctgttcgtgaaaagtatggtgtcaaaaacatcatattctctccggaattcctccgtgagtcaaaggcactttatgatatgctccatccaagcagaataattgtgggatgcgatgacgaccaaaaagaagatgcacaaatgtttgtagaccttcttttggaaggtgtgagattggaagaaaagagatctgattctccaaagcaggatattcctattctaatagcacccttcacagaggttgaagcaagcaagcttttccaaaacacctatcttgcattaagggtaagctacttcaatgaacttgacacctttgcccagaccaaaggtcttaacacaaatataatcattgactgtgtgtgcatggacccaagaatcggaggacactataacaatccatcattcggatacggaggttattgtcttcctaaggatacaaaacaattattagcaaattgcaaggatgttccacaggccctaattgaggcaatagtcaattcaaatgctgtgcgaaaggaattcatcgccgaccagattatttcaaataatccaaaaacagttggcatatataggcttattatgaaaagcaacagcgataacttccgcgcatccgccatacaggatgtta

SEQ ID NO: 861 - DNA, 933 bp, Methanobrevibacter ruminantium
atggagataagatataaaaatttattaaaagtttttactatttttcttgttttactcatcagttgcggatttgcctcagcagtcagtgatttagatgaaggtaattctgcaaatattgttgataatggtgatttatcattatctgacaatatgatgagtgaatctgcagataattgtaaaaatttggaaactattgaggagtctcatactttcagtgaaaaaaacactgttaaagacgtttcatatggactttcaacacctatagatggaaatacttttgaagatatccaaactgctattgataatgctgctgatggagatattattgaacttaatggtacttattttggaaacgggtctgatataaaaattacaaaagatttaacaatcagcggaaatcttgaaacaatattggatgctaaaaacaaatcaggtattttttatgttaactcaaataacgtaactttacaaaacttaaaattttataattcaatagttcctgaatatggaagtgcggttcattttttaagtaatggttctgtgattaattgtacttttataaataatactgctggtggagtttatggtactattgattacttttggtctactggaggtgtagtatatttggccaagggcaatggctctgtgattaattgtacttttataaataatactgctaatgcagatggcggtgcaatttattgtggagttgatggcgggtctgtgattaattgtacatttattaataatactgcaaaagagttagggggtgccatctatattggcggcggtcatgacggtggcgctcattattcaaatgtttatgattgctatgtagataattgcgtatttattaacaatactgctggtgaaggtgctgggatttattatggcggaggcggtttaatatttaatttgtacttttattaa

SEQ ID NO: 862 - DNA, 1024 bp, Methanobrevibacter ruminantium
atgaagataagatataaaaatttattaaaagtttttactatttttcttgttttactcatcagttgcggatttgcctcagcagtcagtgatttagatgaaggtaattctgcaaatattgttgataatggtgatttatcattatctgacaatatgatgagtgattctgcaaataattgtaaaaatttggaaactattgaggagtctcatacatttagtgagaaaagcactgttaaagacgtttcatatggactttcaacacctatagatggaaatacttttgaggatatccaaatagccattgatgatgctcaagatggggacacaatccaactaaacggcacttatcttggaaatggaagcccaataattttttcaaaaaacttaactattggaggtagcggcgaaacaattttggatgctaatggattatctggcattatcaattcgtcttctgaaaaaattgtcttgaaagatttaacatttgttaatgggtctggattcacagttgatttgagggagaataatggtgataatttaaaatattgctcaataattaattgttcctttgaaaagtgttatggggataaaaattctgccgttatctgtttaaatggatctggaataatcttagattgtgattttcactatactaattgcactataaatattatgggttctgaggatgtttccattttaaactcttcttttaattatactggcggatatgctatccattctaattcaagcaccattgttaaagcatgtgatttttatttcaatagtttctttgaaacatattatgagaatactaataaagtgtacaatggcaatattgttgacttatgtaagaattcatcaatcagtgattgtatgttcaaaggcacatattatgaaacaattattgattccctagttgattccaatacttatcaattcagcacactccatgtctgtgatgaagttgatgttataaattgtactttcattagatctataacagaattttctggttctgccatttacc

SEQ ID NO: 863 - DNA, 840 bp, Methanobrevibacter ruminantium
atgcaacgttcattatttgataaagttaaaacatccttatggatgcttccatccttttttggattggtaaacggcttgggatttatctatctcggacgaaagaattccaacatcaaatggaccattgaaggaattgtctatgaaattccttggttaatcgcaatcctaaacatctttaacctttcagttgcaatcactgcattttctttaggatcatttatggttcttataagcattgtccgctctgtaatggttaattatgaatatcagagattgcttgatgaggaatatgtggttcgtccttctgttgaaagcggttctcatggtttggataagcaaatcaagaatggtcaattcaacgaaaaggaagcttctcctaaggaagagaaagttaaatataatccttatgacttaagcggcatcgacaagaattatgatgggagaatcaagttcgacaagtataaggctgaaatcaaggaaatggaaaaggaattcaatgagaagaatgataatgtaaaggaattggttgaaaaaagattctcccaatctggaatcacttatgaccgattcatgtttatcataaaggattcagaggaccttttcaattcccaggcagccaatgctttggatatgattgatcttgctccagaatatacagagacaatcgatgcagagataagaaagaaaatggaaaccttaaggacaatcattgagaaaaatgatgaattaagggatgagttgatcattaatatgacaactgagactggttcagagatggaaatcaagaatctctttgaggatatgggacatctgaccagttccattaagcattatgaataa

SEQ ID NO: 864 - DNA, 1024 bp, Methanobrevibacter ruminantium
atgaaatttaagaattcacatatcttactcgtttcattaatatccattttcctattgttgagcataagcgcagcttctgcagctgactctgatattgcagcggatgacagctcagtggatattgttgaaatagaagatataaatataaaagaaagccactatctctgtgatgatgcctctactggctcagaagatctaagtggtgatgaaaatacaagtgcatcaggcactgatgacgctacaggtggaaatgacactgatgctacaggtggagatgacactggaaatgctacaagtgtaaatggcactgaaaatgttactgatagcaatggtacaaatgccactaatggaacaaatgcaaccaataataccaagtatgacggtcctgtaaccaatgcaaccatcattcctgtaagcacttctgctgattatcaatatggaaacttcacattcaaggtagtggacaatgcaaccggagagcctttggcaaatcaaaagatatctgtaagcggagtatatttctttacatttaataacggatcatccatatccactacaaaggtattcactaccaacagcaacggtttgcttgtcattgcaaacaagaacttaaataagaaccttgacacacttggtatggtatataatttcaccgctcttgatgtgggcaaatacgaccttaccttcagcggaaatgacagcttaaagattgttgtcaacaataccctcccaatcactgtaaataaggtcaatgcagaaattaaggcaagcaacttcaaagatgaagttggaacaagtaaaaaatatacatttaagcttgtaaataagaatacaggtactgttatcaaattagccagcctcaagttccaaatcaagttaaacagttcaggatatacaacctataattcaacaaccaacctttcaggtcaagtgggatataacctgaaccttttggccggcacatatcctgttagaatcgtcaataatgattcaaatctaaaggctagcactgtaagccgcaatg

SEQ ID NO: 865 - DNA, 672 bp, Methanobrevibacter ruminantium
atgaattctaaaaagatagcaattgttcttggaataatattgctttcatttgcaattgtaggctctgcatcagcttttaacttatttggcggacctactactgactttgacaataaattcatgtcaggtacctttacaggggatgtaagcagaaacaatataagcaccaatgactccctatccgactgggtggactcctatgaggataaggaaagaaatatcacttataatatgtcttgcattaagggaggctcattcttaactgacctatatgaattgcagggtatggcagctcctgaagtgaggaatttcaatggtgaagattggaaggtctattattctcaagcagttcctacaacagatgaaaacaagacagctaatgaatccagtgtaataaatgtctacatctgtgaggcagatgtggataatgtgacctatatgattaatatcattgcatatgacaatgaatcaattgactgtgatggcagtctctactgcggattctttaaggatgacattcagcctttattagagagcattactcttaaggatgctaagaaggctccgcaaatatatgatctcttgaatatgactaaagatgattttaaacaattgcaggattatatagaacaggtcaaaacaggaaatattcctgaaactgctgaaggatag

SEQ ID NO: 866 - DNA, 1024 bp, Methanobrevibacter ruminantium
ttgtcaaacagtaatacagatagctctgataatgcatcagatgatgcttcaggatctgaaatagtatcaggaattaacgaagagcttgaatcaaataatttattaactgaagatttaagcgtagacgatgtaattttacaaactagcttttatacaagttatgcagttaaatctgcaaaatctcctactgtattaactttcaaaaactctacagtggtaaaaggagataaattatacatttacttaaaagacagttccaatcatggcatttccggcgaaaaggtaatatttaaattttcaaattcatcttatacaagaactaccgattcaaatggaatggccgcacttgacattaaacttaatccaaacaaatatgctttttcagcaatatatgatggcagcgataattatagcgcttccagaaaagactttactttaactgttgctaaagtcaatacaaaattgacttcaagctcaagtgttgtaaggggaagaaacctatacacttatttaaaggataaaaacaacaatgccctttcaaataagaagataagcattaccatctctggaaaaacatataccgttactacagacaaaaatggcagagcaagcctaaaattaagtttaaagacaggaacttactcaacaaaaatcaattttgctggagataaaacatataactcccagtctttatccaaaaagataaaaatatataccttaaagacagtcatgacaattccaagtacttcagttgtcagaggtcaatatatttatgcatatctaaaagacagtgacggaaatgcactctcagggcaaaaagtggtaatgaaattcgacaaaatctactttaacctaaaaacagacaaaaacggaagagtagccctgaaaataaatacaagacttggaaaaatcccagtaaaagcaagcttcgcaggatcaacatcctactcagcaagctcaaaatcagtcactattacctcttatgttgaaaaaaccaagattacagttgaaaattcaacagtga

SEQ ID NO: 867 - DNA, 1017 bp, Methanobrevibacter ruminantium
atggatgaatgtaaacttgtattaatcggttttggcgctgtaggccaaggtgttgcacgtgcaatatccatgaaaaaggaaatgatcaatgagaagtttggcataagcctaaaagtagttgcagctggtgattcatccagctctgcaatatgccaagacggtttggatgaggaattgctccttaagactaaagaggaaactggcaaattagcaaactatcctgaatatggaagcgacatctctggaattgacattttagatgcagttgactatgacgtactcattgaagcaactccaaccaatattgtagatgcagagcctgcaaaatccttgacattgaaggcatttgcagatggaaaggatgttgtaacctcaaataagggacaccttgcacttttctataaggaaataattgaagctaaggaaaaggcaggagtcgactttaagtttgaagcctcagtcggcggagccatgcctataatcaacctatgtcaggaaacattggcaagctgtggaatcagctcaataaaaggaattttaaacggtacaaccaattatatcctttcaagaatgacaacagaaggcatgacctatgagaataccttagcagagtcccaacaattaggtattgctgaaactgaccctacacaagacgtagagggtattgatgcagcatgtaaggtagtaatcttggctaattctgttttaggaatcgatgcaacctatgatgatgttgaagttaggggaatatcagatgtttcattagaggcaatcaatctggccaaggaagaaggctattatgtcaagttgattggtgaagtgtccagaaaacaattgaaggtatctccaagacttgttaagaaaaacagtccatttgcaatagacggtaccttgaaccttgcaaacattacaacagaccttgcagatgacatcactgtaatgggtaaaggtgcaggttccttggaaaccgcttcagccatgcttacagatttgattaatattataaagaataagtaa

SEQ ID NO: 868 - DNA, 1024 bp, Methanobrevibacter ruminantium
atgggtttccttgataatgttaaaaaaatttttgattctggtgaaaataaagaggttaaacctcgaaatggtactggaaaaatagataaagttgaatctgttgaaagtaaaagtaattatgttaattttaatgaaaaagatgaacaacaacaaaattcagaggacctcattaatgatgaaatacttgatgaatcaacatccaatgaaactagaaatttcacatatctaaataatttaatccatagtggagttaaagagattattttggattcggatattgtttatggtaatgaggatgaggaatccagacatggcattaaattaaatcttgataacctagttattgatggtaatggatacacaatagatgctcttagagcaagcgaaatatttatttgtgatgctaggaatattgtgataaaaaacattacattaaagaatgggttttctcatcaggctggggcaataaataatcagggagagttaacaataataaaatcttcaattaataataatgaaggaaaattagccggaggaatattaaatcttggtgaattaaccctagatgaatctgtaattgctaaaaataaggcagaacatactggaggaatacttaatttctttggtaagctaagcataacaaaatccaccctcaaagagaacattggaattggcaataaagcaatatctaataacggaggggaattaactataaataaatctagaatcattaataaccagatagacacaaagacaaattttgttaataaagccaggacagtatttgttaataaagccattaaagcacgacgtgatgcagttatatcaaatgggggttatttaaggataagtgattctgaaattttaagtaatgaatcaaagtatataattttaaacatagagttctcaagaatatataatactatttttaaggctaatgagtcacaatatatcatatataatgataattatgaggataatggattatctagtttaggtatttttaattgtaaatttatagaaa

SEQ ID NO: 869 - DNA, 336 bp, Methanobrevibacter ruminantium
atgatgaggaaaacaatatttggagttatatttatcgtttttattttattcagcatttcaacggtttcagcaaacgatgctcaagttgacatgcttaatgatgcaagtgatgtggaattaaatcaagacttgaatgctcagcctatttcatcaaattgctatgataataatcagaatttaaaagctcaacctatttcagattgctctgatgagctacagaaatctgatgatgatttaaagctttccgaagggggatcaacaagtttcaaacagctttgtgaagatttaaataaaagcgacggcgaatttaatctaactcacagctataaacattga

SEQ ID NO: 870 - DNA, 1024 bp, Methanobrevibacter ruminantium
gtgataaatggaaataataatattatagatagcagcaaatcaaatttcaactttaaattttccaatgaagcaaacattaccatcaatgatttgactttcacaaatttcaataaatccctatttgtaatcagtgacagccaattgacctttaataacgttaactttactaattgttcctcaaatctttcattgattgcgataatgtttcctagcaatttgactataaacaactgtaatttctattcaaattcatttgcaaattatctcgacggaccatttaacaaattagagatttataattcaaattttgatgggacaaattgtttagattctgctattaaagagaataggggccaactagtcattgaaaattccagctttgagaatttcacaggggttcatggaagcataataaactacaagggagactatttctctattaaaaactccaaattcatcaattccaattcaaacttcactggaggagcaatcattgtaaaatatttccctattgcctatgaagaaggagattcatttgtctatcgtcactctaatgacatgctgattgagaattgcacattttataatctttcatcttccagcaatggaggtgcaatccatcttgaccttgattcaggctctgaaggtattgtagaaactttaattgtaaaatcttccaacttcacagactgccactccaagtttggaggagcaatatccattttaggcggttatttaaacatttcctattccaatttccaaaacaatagcgccagctttgaaggaggggcgatctactcctcatggaccaatgcaaagattgaaggctctaattttactgccaatgaaggaagtcaaaatgcaggggcattatactttgacaagggaaaattgacaatcaatgactgtaagttcattgataataaggctcttaaggaacgagagagaactgcaaatgcaatctatgctcatgatgtagctgcctatttctccaattccacttttgacaatggaggagtatcag

SEQ ID NO: 871 - DNA, 249 bp, Methanobrevibacter ruminantium
atgaataaacaaaacgtatttgctttgatattattaacaatcattcttttatctgtagttgctgtcagcggatgcattggaaaatcctctgataattctgcaagcgattcatctggagattccgatgattccagtaattccatatttcacagtggctctgacagtgacgatgatgataatgatgacaataatgataaggacgacaaaaacgataatgataaagacgataaagatgatgatgacgattga

SEQ ID NO: 872 - DNA, 1024 bp, Methanobrevibacter ruminantium
atgttgaataaaaaaataataataattttaacatttattttaatattgtctatttcttcagcaagtgcatctgcagattcaacagatgaaacaatcttatcagatgattctgcagggcttatcaatttagacaattctaataataatctttatttagatgataatcaatttaatttagctaattctaattcagataattccaataactttaatctagatgattctaattcagataattctaacttttatctagatgaagatttagacaataaaatcaatgaaaatataaaaaacactaaaacaatcttaaaggagaataattcatcaattgcttccttttcaaacctttcacatattctatcaaaggcttcagcaggagatacaataatcttagaaaatgattataaatatgattctgcctatgatagtcaatatcagggaggaattgaagtcaattccatcacaatcgacggaaacaaccattatatcgatggaaatggagaggccagaatattctatttggcttcagacaatattgtcttaaagaacatcaagtttataaacggtttcaatagtcaagggggagcaatctatgcaaaaggaacaaatgtcaatataactgactgcatatttgaaaacaatcttgccccagataatggaggtgcaatctatgttgaaggaaatgcttcaataaaatccgtaaaattcataaataactctgcaggatatggaggagcagcatatataaacgattcctccattcttgaagatctgatattcacaggcaatgtggccaatattgaagggggagcagtttacattggaggctcaagcaatataactaactgtatttttgatggaaaccttgcagataagggtgctgcaatatttattccagctaaagaaagccctatgactccaagtgaggatgttccttttgatgaatcagatttaaattctacagatatggatttagattctacagatatggatgataattctaccgattacaatttcacagata

SEQ ID NO: 873 - DNA, 492 bp, Methanobrevibacter ruminantium
atgggagtattagctagtgttgctggaggcatattttttgaagcaggcatgattgctacttgtacaggtgttggtttgcctgtaggtttggctttaatgggtgtaggtacaatttgcactgcttatggctctggtttatttggcatgacagacacgggcaatttctattctaatctaactgatgaaaatttagccgattttggcttttcaatgagtttaaatctcattgggggagggtatagtgcagctgctgcgaaatctacattaaggactgtaggaggtaaatcggttcagatttccatatctaaagcggcatttgcaagtgaccaaagaggtgcatacaccacttttcatacaattagttctaaaacatatattcaaaaagttgaaaatggtgcattcagtaactgtggagaatacttaatagaacaagaatttggaacaacagtaattgaaaatataagaaaatcattaagagtttttatcaattga

SEQ ID NO: 874 - DNA, 1024 bp, Methanobrevibacter ruminantium
gtgttttcagtgagtttaaataaacttaagattggtagagtttttatttgtctttttattttagtttttatttcttgttcaattaattgtgtttttgcagttgatgatttagctttcaatgatacatattattctgatttagattctgttaatggggattattcaggttttcttagtgaaggagactttaatggaggctcttctgtggttgttgatggtgaaattgactcctctccaattgccaataataaaaagaattcttcatttgcccttactagcaaaaaggattcatcttcaccttctatttccacatcatcaaaaaacaataaaaacaataaaaacacttcttctttaaaggaaaacaagaccgccgccccatcttcacaacgtgtattttatgaccgcgacatagtgtctgatgaagatgtaatcggacctggtcatgaaaacttggactggattaacctaacacatgtcgacgacagcctattttcagataattcaaaggaagatggagcaaaaggcagcaagattgccaccaccattgtcgcaagcaacctagttaaatattatctcaatgccagccaactaaatgtcggcttgaaagactccaacggcaattacctctccggaaaaacaatcaatttcacagtaggcagcgcttcatacatacgcaccaccaactcatcaggcagatgctccctaacaatcaacctaatgcctggcgtctatactttcacaatcagattcctaggagactcctcatattccccaagcagcaaaaatgtcaacgtcacagtcctaaagatgcccacaagcatcacagcaagcaacctggtgaaatactatcacaattcaagcagcctaatcgccacattaaaggacacacatggcaaccccctatccaacatgacagtaacattcaaaatgggatcaaacaactataaccgcaccaccaacacaaacggaaaagccacactagcactaaatatgatcccaggaaacttctccgtaaaaataagct

SEQ ID NO: 875 - DNA, 1024 bp, Methanobrevibacter ruminantium
atgggaggtgaaataataaataatgaaaaattaaagttaattttaattttaaccttaattttttcaatattaattatgaatacagtcaatgcaagtgacaatggtatcattgcagaatacgctgatatctccacaattccaaatgatgaaaaggtttctatcaatgaaaatgactatgatacaaattattatgagttacctgataaaaaattagatcatttagaatcaaatgataatcaaaatcatttagaaatgaatgataaaaaactaaatgatggaaactcaaataatgattttaactatatacaagagttgatcaatagtcataaagatggagattcaatattcttagaagacaaaacatatataggcaatggaagtccaattatcataaataaaaacctaaatatttatggatatggctataaaaatttatccgatcttgacataaaaacaatactggacggaaactccaaatcaaacatatttatcattaataagggaattcaattaaatctttatggattaagccttatcaatggaaatacaagttatgaggatggaggagccatctataacaatggactattgagtatagatagctgttcaatttcaaacaataatgctggcggaggagcagtatactcctctgaaggctcagaaattgaaatatacaacagtctctttgaaaacaatagcggacttcttggaggagccttggatttggaaaatgcaaatgcaataatatccaagtccacattcaaaggcaacagatgcaatggagacggaggagccatttacaataatattggaaagctaactatctctaattccaccttttcctttaacaagggagctcgtggcggtgttatctacaataatcatggaaccctatcaatatacgattgtgagatgttcttaaactctgcaagccaattaggaggtactgttaaaaattggggaagctgtgaaatatacaattccacaatcaaaaacaatactgcagacatgtacggaggaggat

SEQ ID NO: 876 - DNA, 447 bp, Methanobrevibacter ruminantium
atggataagaaaatgattgtttcagtggcttttcttttattgattttggcagtggctttagtctctgtatttgatgaaagcaatagctctgaaagtaaagtaaacttaatcgtttattctgaaggcccaaagtccttatctgaacttgtcaatgaaattaagacccaagactattatgaaggatatgacaatgagacagttgcctggatggagtccttaggaaataagaaattttattatggtgacggaataatagttattatgagcgcaactgatgcaagcaagcttccttccttatatgtcaccgatgtagagctttttgagcattttgaatgtaacgttttggaaaaacgttctttaggaaatgtagagtatcctaaggatgtcctgtatgtcaagaatgtaaaatacatcggcgaggaatatggtaacttttcaggggcttaa

SEQ ID NO: 877 - DNA, 120 bp, Methanobrevibacter ruminantium
atgaaaatctcaagaataattgtattattaatgattctaatcttcactgcaggaatggtttatgcagtagatttaagtgaatttaaacttaatttaagttttaaattctcctccccttaa

SEQ ID NO: 878 - DNA, 486 bp, Methanobrevibacter ruminantium
atggattctaaaaaaatattagttattttaggtttaactgttttagctatttttttagctagttcagttagtgctggtgacttgatttctactgggggttataatccagattcacttattatacttgaaggagccgattttaacattccagatggatttgaaagaattgaggataaatccattgcaaatcagacaagaaattcaggagtcttttcatccattttaaatagggaagtttatgggaatcctaaaggtgaggagatagtaatttctgttgtggattttgataattttgatgcaaatctgccaattcttagcatgatttgcaaaggctgccaaaagaaggaattgcttggctatccaggttttattggctctgatggaaactccactaagttttcttatgtatttgataataaggtggtgtctatatccgctccaaatgaggatttgattaatcaggttctagtggttgaggatgcatag

SEQ ID NO: 879 - DNA, 948 bp, Methanobrevibacter ruminantium
atgaaaccatatgtaattctcataggaagcgcttcagggataggaaaatccacagttgcagctgaacttgcaaaaacattaaacattaagcacttggtggaaaccgattttataagagaagtagttagaggaatcataggaaaggaatatgctccagcccttcactcatcatcctacaatgcatattccagccttagaaatcaggaaaattacaaaaaccaagcagagcttatcaatgcaggatttgaagagcatgcatcatttgtgcttccagcagtagaaagggtaatcgatagggcaataaaggaccatgatgacattatactagaaggggttcatttaatacccggctttattgacatagaacagtttacagacaaggcatcggtctttttcttcatattaagctccgatgaggaggaccacaagaaccgatttgtaaaaagagccatggaaataagaaggggaggaaagcagctagactactttaaggaaaacagaataatccacgaccatcttatagaacaggctcaaaagcataatgttccaatcataaaaagctatgagattgaatcaaccgtcaagaagatgctatcctacattaatgaaacctgtgaaacaatatatctgaaaaacacagttgatgaattggataaggtaggagaaatcatattagacagatacagcggaagcataaagaatatctcctatccgatcaagggatttaaagagcctctcataagaaagatagatgtaagcgagataagggaatatgataagtttataaagaacctgaataagttcccagagaaaaaggaagaacttaaagaactttatagtttaactgactatagagcatatcgcatttgtgcaataaataatgaaacaattgaaaaaattaaaaatgaccttgataaggaaggtttgctctttaaagaagatatgtaa

SEQ ID NO: 880 - DNA, 393 bp, Methanobrevibacter ruminantium
atgttaatatcagtcttgggagtgattgtaattatcattatggtagttgcagctgcttatgttggatttagcgttgtttcatctagtttgactggtggaatttcctctggtactcaatatgatgagttagcaaccttaaaatccaattgctctagtttagaagcccaattcaatataaccggaactaagatttatgcaatgcaaaacattaccttagaaagagagtttgtaaatgctcaagtggagttaattaaggttcaaaatgatttggatagtgttgaaagtgcattggcatccggtcagcctgcttcagaagttgataaaagaatacaacaatcaaaagaagatttaaaaatagctcagcaggcttataatagtttatctgttaaataa

SEQ ID NO: 881 - DNA, 174 bp, Methanobrevibacter ruminantium
atggcaaccagaacaaaacaaactatatgcaggttgtattccttccatgggggtcgtttcttaatagccctgtcagtttttcccctaaacgtttcttgcggtttattatttgatataagatctcctcctgagaagaaatttggcattgtctttttaaattttttctctaaatga

SEQ ID NO: 882 - DNA, 294 bp, Methanobrevibacter ruminantium
atggaattaagtaaaagtgacaaatatttaatcgtagtagggattatattctgtcttgcattagcagtattatctccttacattgcatctggagacccagatggattagaaaaatcagcagaagatgcaaacgttggcgaagatgttgaagctccagtaatggaagctccattcccagactatacctatgagcctttagaaaaaataggtgaaatcggcgtattgattctaggcgcgctgataacacttattgttgcatggggtataggttatgcattgaaaagatctgaataa

SEQ ID NO: 883 - DNA, 1017 bp, Methanobrevibacter ruminantium; identical to SEQ ID NO: 734

SEQ ID NO: 884 - DNA, 1024 bp, Methanobrevibacter ruminantium
ttgtcagttattctgattctgtttttagcagtttcaacggtagctgcaattgatgtggatacgaatgataatttggatgatggtagttcttctaattcagatttaattagttcttcttcattggattcttctagttctgatgatgtttcttctggttctagtgaggtttctagttctgatgaatcacttgatggaaataatttgtctgatggtaatgtttcttcttctgatgagtctgttggtgctgataatttgtctgatggtaatgtttcttcttctgatgagtctgttggtgctgataatttgtctgatgatgagtcatcttctgatgctctatctgaagaattgcctaaaactgaaacagtcattaaagcagacccaataaattataattatgcttcagttaaaggattaaccattaatctaacagattctgcgggacttgctttatccaataagactttgactgtcaaggtcagtgctttaaataagacttctaatctgactaccaattctaaaggacaggctatctttaagctaagcgcttctgttggatcatatgatgtttttatttcttttactggggatgaaagctatgctccatccaatgcaagttctaaaataactatcaaaaagtcctcaacaaagattaaattgagcaatattcacggatatttgactatttcaaattatgtaagtgtcacattactggattctgctggaaagcctataaaaagcaaatcagtaacaattcaagttaataaggcaaaatataatgtcaaaacagacagcaaaggcattgctaaagtcaaggttgcaaataagattggaacttactctgtgaatgctaaattcagtggagataagaattattacgcctcttcaaatagctccaaattgacaataactaaaatgaaggtttatattaaggctccatctgtaaagtattatatgacaaacagctctgctccttatttgacaattaacctgactaacgttaaaggcagtccacttgcaaaaaaga

SEQ ID NO: 885 - DNA, 726 bp, Methanobrevibacter ruminantium
atgaataagaaacttaaaataatcctttatattttattggctttaataatcattattgcaggaattagcctttggtatttgatggattattctcctgcaagtgcagatgctaattctcttattaatggaacatcagaggtttcagtaagtaaaataaacaatggattgttcttagatggtcctggaaatgatagcgctgtcatattttatcctggtgcaaagatagaatacactgcatatctgcctttattaatcaatctgtctgcagatggtgtagattgctttttagttgaaatgccttttaatttagcattctttggaacaaacagtgcagatgaaataattaataatgcttcctataattattctaattggtatattggaggacattccttaggaggagtcatggcttcccgctatgcccataatcattttgataaaatcaaaggagtgatactccttgcagcttatcctgcagatagtttagagaatggttctgtgctttccatttatggatccaatgataagtccttaaataaggaatcttatgatgatgcaaagaaatatatgccaagcaatttcactgaatatgtgataaaaggtggaaatcatgcccagtttgcttcttatggcaatcaaactggagatggagtagccactatttccgcataccagcaagaaaatgaaaccattaaagatattcttttatacatcaatggttcttaa

SEQ ID NO: 886 - DNA, 606 bp, Methanobrevibacter ruminantium
atggaaactaaaaatcttataatcatttgtgcaactgtaatattggctgttgtaatagttttatctgcttttatttatgtcaacatgggcaatgaaactcatataagttctaatattgcagatactttacaaaatggcgatgaaatcgttgtcaagcttgtggataaggataataagcctttggtaaataagaccattagcttaaactttaaagatgaaaatggcaagggcaatgccgttagctatgatcttcttactaatgacaaaggtgaagtatattataatgtcaatttgactgaaggaaaatatgtattttccgcagattatgctggagaaacatttattggctcatcaagtttaaataagtctgttgaagttaaaaaagatgttaaaactgcaaatctcagttctacagatacgactaaaaccgctaaaaccaagacctatacagattggcaggaagactatgagactggacgttatgacgaagacggaaatcctatctataggtctataatgtctacctccggaggccaatatgagcctggaatctatgaatgctattggtctgcaaatggtccaatcagtgaaagaagaattggttaa

SEQ ID NO: 887 - DNA, 669 bp, Methanobrevibacter ruminantium
atgattattaaaaattattctaatgaacctactgatgaagcaaaggtagattcaagtttatatgatgctcaattaattggagaaaacgatttaggaactgtacaccttcatggcccatttggaaatgaggaatcagacattaagatagcttatctaatcggcatgcatcctttggagagcaaggcacatagggctttatttgatacagttcttgataaggatggggatttgaattattcatattatatctataacataaatgttataggagaacttgatgaggcaactgaaggtcgtatggatggccagcttcttgctcaggagtttgtagcccatcatataattgataggggatacgatttctttttagacattcatagcaatagggggtctaggagtcctggaacttatgaaataagcaattttctatttgctccaggctttgatgaagaatctagtaaatatatgaatgtattgctttctaagatagatgaattggtttattatgctcctgaatatagaacaagtcctgaatttattacagttcctgttcaaaagagtggaattcctacactagtttatgagacctattcctatgagccaattgagctcacttatgaattgagtgaaaaattagtggatgctgttgacagtttggactttgattga

SEQ ID NO: 888 - DNA, 762 bp, Methanobrevibacter ruminantium
gtgcttgttttagcttttgcaataatatttctaggatattccatctccttaggaaacaatcaaacagcaggtgttaagctaaatgattccaataagatttatattaatcaatcttatccggcagagcctattccagatgctaaaattgatacaagcggtgtaaattcagttttattaggtcaaaatgaattaggtagcgtagagcttctcggcccatttggaaactccgattcagagattaagatagcctattcaataggtatgcatccttgggaaagcaaggttcataaggctttgtttgataccgtccttgctaaaaacagctctttaaaatattgctattatatttataagataaatgtgacaaattataatactgatgatgagggcagaatggatgggcagcttcttgctcaggagtttgtggcacctcatataattaatggagattatgacttgtttttagacattcacagcaataagggaactgttggaggaacttatgagcaaactaactttgcttttgcagttggtcaagatgaaaagtccgaggcctttgtaaagaaaatattagataagatgccagagcttgtttattatttcccagctgatcagtcaagccctccttatataaccttacctgtagagcaagcaggaactcctacagttaattatgaaacattctcatatgaggacattaatacaacctatgatttgattgataaattggttgatgtggttgataatttggagtttaaatga

SEQ ID NO: 889 - DNA, 399 bp, Methanobrevibacter ruminantium
atggaattgaatgatgaaataatatttaaagttgcactgattactgcattggtcggaatgattgggatgctagcttttgcctcttatattgaaccaaaggagataacaatcaatgaaattacaagaaacaatattggtgagacagtttctgtctctggtgttgtagagtcggttaaattatcctcaagcggaagctcctgctttctggagctaaatgacggaacaggtaaaataaatgtcattgttttcgaatcggttttagtggagcttaaagatgctggaaacgacttaaatgattttaaaggtcataatataaaagttgtaggcagcataacagaatataagtcttctatggaattgattttagctaattccaattcaattaaattggaatcttag

SEQ ID NO: 890 - DNA, 771 bp, Methanobrevibacter ruminantium
atgaaaaattatttcgacataaaagacaaagtagcagttgtaaccggtgcttcttccggattaggttggcaaattgcacaagcttacgcaagccaaggtgctaaattagctttattcgcaagaagagaagaaagattacaagaaaacgtaaaagaaatcgaagacaaatttggtactgaagtaatgtacgctgttacagatgtcggagattatgacagcattaccgcatccgttcaaaaagtaatggacgcatatggaagaattgacattctcgtaaacgcagcgggtatgggtaacaacaaaatggttgtagaccaatccaacgaagaatgggcaagacacatccacatcgacttaacaggtgtatactacatgtgtaaagctgttggagaaatcatgattgaacaagaatacggtaaaatcatcaacatcggttccatccacagtagagttatcttccctggcggaggtatcagcgcatactcctctgcaaaaggtgcagtaatgaacttaaccaaaaacttagctgtagaatgggctaaatacaacattaccgtaaacgcaatcggccctgcagtattcgaaaccgaattaactgttgactccattgaaatggacggattcatggatctcattgcagcatactgtccagcaggcagattaggtaaacctggtgaattagacggacttgcaatctacttagcatctgacgcatccagcttctgtaccggtcaattaatctgtgttgacggtggatggactgctatataa

SEQ ID NO: 891 - DNA, 129 bp, Methanobrevibacter ruminantium
ttgactttcaacaaccttagaataaacattaaagattgcatggtaatatttgtagtgtttacagtattgcttttatctattttagctgtaagtgcagctccaagcccagattttatgctctgggtataa

SEQ ID NO: 892 - DNA, 1024 bp, Methanobrevibacter ruminantium
atgataagcatctctgcaataagtgctgcagatgactcatcaatagctactgacgattcaaacaagataatcaatgataataacaatcaggacattgtattagaagaaaatggaccctcaacaaatatagctttagaagacaagaattataaaattgaaaagccacagcttaaggaaaatagcccaggcaattttaccgatttaaattatctaataaatgaggatgaaaccacccgccataacactacaatcactttagaccgtgactacatcggcggtgagaaaggcataagaatcgatcgtcccctaatcattgacgggcaagggcatacattaaatgcatcccaaaataacagagtcttccatattacttcagaaaatgttacccttaaaaacatcattttcacaggaggtagatcagattatggtggcgcaatttactggcaaggagacaatgggaagataatcaattgtaactttacttacaacacagccactaaatatggcggtgccgttttctggggagatgacgaatttgaaggtacagctgaccaaacaatagctaaagatggaattataataaactctaatttcatctccaataaagcgaatgtaggaaatggagaggcctgggaaaatggcggaggcggagaaggtggtgcagtttactggtatgccaataatggaaccatatgcaactcctatttccataataatcgtgccggtggacaaggaggcgccatcacttggaaaggaaatgatgggatcatatgcaataacaccaacttcactgccaatagtgcaggagattctggcggtgccgttttctggcgtggagataacggaaccataagcaataactgtgagtttaataataatatagcctatggtcgtaccagtgatggcatatccagaggaggaggagctattttttgtcatggcgaaaatggtaagataagcaactgctcttttatggaaaacagtgcaaaacctgaaagtgaaagcggtaaaggaggaggagcaa

SEQ ID NO: 893 - DNA, 1024 bp, Methanobrevibacter ruminantium
atgaaattcaaaaaatatttatttattctgctaatagctcttatttgcataatcagtgtctctgcagttgctgcatctgatgcaaatgaccctattagccaagacaataatcaaggactagttttagaagaaacaaatcaggatctttcgataactaagactaaagaaatagtggaatcaagcaccaataaagaaattagcctagaagacaacaaagttatttctaaggaaaataagaaaacaagtcttaaagatgaagaaacagactcattcaccaatctaaataatctaataaacatagacaaccccaacaaccatacaattagcctaaattgcgattatgtcctcttggaagaggactgcacctacattgacactgaaatattaagttcctcaaatcttacaacatcccacatcttaagggatgagggaagcctgccgattgacttgaatccaaaaacatataaagcccgattaatggttgaaaattccaatgaccaatccattgaagtgataaaaaccacaaatatagaaggatcctcattctggctcttaaatcagaccataaacaataacagcaatagtgaaatcacattagatagcaattacacatttaattccagcgcagattccggatttataaatgggatatacatcaaccgcagcttaaagctgaatggaaacggcattacaataaacggattggatgaaggacgaatcttcataatcactgcagacaatgtgaccattacaaacgtcaattttgcaaatggaaaatctgacaagggaggagccatcctatggcttggaaaaaatggaaatatcagcaactgtaactttacagacaatatggcaacatctggaggagccatcttttggggaaatacaaatctaacagattattatagcaatggacaaggggatgacggcaccataataaactgcaatttcattggaaacgaagcccaaaagggaggggcaatgtttttccataccggcggagccaccataaaagatggttgca

SEQ ID NO: 894 - DNA, 903 bp, Methanobrevibacter ruminantium
ttgtacatctcagagatagagattaatcaaaacattatcctaaacactgaaggcaataaaatatatctaaacaattcccctaaaagcaatatacacgataactggtttggaaacactctgctgaactatgatgaggtgccatatgaaggctgcacaaattggatattcctaaatggagaaagcaaccaggtctcactggagaatccgatcagctttgaaatcacatttaccctatcctctttcaataagaatacaaagaaaataagcaactatgatgatagaaagcttccattcaatctaacagcacatgcagagcatggaatcttaaatccgaacagtaatcttttaggaaaaacaacaatatatgaaacagaaatcatcaatgttgagagaataatcggaaatattgcaaatatagattcagaatttgaaataatggagtttttagtcactgacggaaccacattctatgacttgaaccaactcatcaacaacaacagcaataatgaaatcaatataagcggaaattacacatatcatgatgatatagactttgaatttaaagagggaatcaatgtcaaccgcagcctaatcattaatggaaacggatttacaataaacggattaaactcctcacgcatcttcaatataaatggagacaatgtcacaataaataatatttcccttataaacggaaatggatatgaggacacctacgacagtgacggaggagccatatactggaaaggagctgacggaaccctgattcaaagcaatttcacaaacaacagcggatataatggaggcgccattctctgggaaggagacaatggaagaataataaaccaacacattcaaaaaaacaaacagcgcattcgaatggaggaggtgccatcaccataa

SEQ ID NO: 895 - DNA, 1024 bp, Methanobrevibacter ruminantium
atgatctgctatgcagataatctaagcatgatcaacaatacaatggaaagcaacattgcatccgacgacaatggaggcgccattctctgggaaggagaaataggaagaataataaacaacacattcaaaaacaactacgcctctgaagaaggaggggctatcagcataagaggagagataggagagataataaacaacacattcacaaacaacaacgcatcctacagaggaggagccatcagcataataataactagtggagagataataaacaacacattcacaaacaacagcggatatagcggaggaggaatactttgctatggaaataatgtaagcataatcaacaatacaatggaaagcaacattgcatcctacgatggaggagcactttacgtcagcatggattatgcaatgataataaacaatacaataaaaaacaacaatgcatccgacaatggaggagcaatctactgggatagatataagggaataataagcctaaacacaatcgccaacaataatgcaaatcatgggggagcaatctactatgagggatattcttcaaatcttaactataacatcatcttaaacaataagaatagtgaaatctatttcgacaatgtcagaactttcaacggaagcaataattggtttggaaacaatgcaagcaattataatttgaatccaaacactagcttcgaatatgacaatagcccaaatgtaacccttagtgattggctatttttaaatggaacagcaaatccaaaaatagtgaatgcctttgaaagctcccaaatcttatttaaattatattcctatgacggaatattgataagtgaatatgacaattccctaataacagacaccaagctaaacttaagtgcagaaaggggaagatttgacaagacaagcgccagtttcaatgagccgataaactatactgcaatagaagggggaagagatacaataagaggagcaatagataagagtggatacagcataaatctaacaaacaggagag

SEQ ID NO: 896 - DNA, 507 bp, Methanobrevibacter ruminantium
atggataaaaaaatgacagttttattggttgccctattttgccttctctgtgtaggctcatatctaatctttgaacctgccaggcatataagctatcatgaggtcaatctcactgacacctgcgttgcaaaggtcccggtaaccgataaggtatcttcatatacagacaacttaaacattcactactattccgattatgaaaacgatcttaacattacaagtttttatgatgtggctccggaatcttcgtctcaagggcatctgagaatggacaatcttaaaaaggaagttttaggtacggaaaagggaagtgcaggcaatctcacttattataaaaacaataatgccggaacttacacaatgtatgttgaagatagaatgtcacataattatattttgctttccgctaaggacttaacaattttcactaatgtatattctagcttagaggctagaattgtggtaaatgaaactgatattgatagtttggactcaagctatgcttaa

SEQ ID NO: 897 - DNA, 480 bp, Methanobrevibacter ruminantium
atggatagaaaggacatcataatcataatactcgttctcataatcatatcactattggcattgggccttcataatcatcaagtaactgaccaaggcactgacctatatcgcactgtaaaggtatctcctagcttttcgctggatgttccactctcaagcaaccttacaagggaaaacgtcagcgaaaacatgtatattgtaaacgactaccaaaacgacattcaaataatctcattcaatatgaagaatgcctctaagatggaccttatcgaggacggctaccaatatctcaagagagaggagtcatataagttcggtgcagaggagatcattaagatatccaatcataccgtatggcacaataaggatgatggcagctatattgcattcttttcacctaacaatacagaggacaatataatgcttgtaactcatgacaatatcactatggctcgcatattatctagcgcaaggtattga

SEQ ID NO: 898 - DNA, 1024 bp, Methanobrevibacter ruminantium
atgacatctgagattatgattttaacaccaactgcagtggttttagcggcggacagtgcagttacaataagcgatataaaaacttatgatggagcaaataaattattttaccttagcaataaacctccaatgggagcattaatatataatcttgcagattttgtagatattccaatagaaacaatcattaaggaatttagaagaaagattgatggaaaagaggatttaagccttatagaaataaaagatgaattcgaaaaatatttgcatcagataatttccaaatcaaggtctactttaagtttccaagagcaattggattattttatagaatttattcaagaagaattgtcttatgtagattttgatgaatttaaaattggtttaaaagatgaactttctgattttgatattggtcttttaggcgattttaaagatgaggttcaatcacagattgatttgtatgaagataaatttagtttagcacttccagatgattgcaatggtttggatgaagaagattttatatcggatttaaaaaaattgtttatctgtaatatgtttttaatgccttttattggcatagcaatatctggctttgagaaagatgaaatgtttccttcatttattcattttaagataaattatttgtatgatgaagaatttcttttaagggatgttgaatttggatcaataggggatgaggaagttatattaaaggcattagctcaagatgatgtaataaatacctttttaaattctattgattcaaaaaccgaaagggcattggaagatttttttatagagtttaaaaattttttatttaattatattgaatattgtattaaatctaatgaggatattagtgaggagaatgaaaatttcttattagaaaacatatctgatatggaattttctgatgaaaaagttagaaatatttttattggttttatagaatgtttgaaagcaaaacagaagaaaccaattttagactcaatttctgttttgccaaaaggagaattaa

SEQ ID NO: 899 - DNA, 1024 bp, Methanobrevibacter ruminantium
atgggctttaagagattaaaaagacttttttcatcagataatgataatgaaatggaaaagaatgaagaaaaaaataaatctggtgaagaaactttttatgaggaatctgatgaaaaggctttttatacagaatatgatgatagtggctttattttagataataattctgatgattcttttaacaatggttctgatgatgacttatctttgaatgatggtttaaaagaggatttaaatggttctgatgataatttatctttaaataatggttttgaagaggattcatttggttctgatgatgatttgaccttaaataaccaaccgtcctcaaatagaaacttcaattatttaaataatctaatacatagccaccaaaatgaaatcaatctggactcagacattgtctttgatagccaaatggacaacacctaccttgaaggaatcaatttggatatggataatcttacaattgacggcaatggacgtacaattgacgctcaaaagaaatcacgcatctttaatgttttaggagaaaacataagattcacaaacatcaccttcaaaaacgcctattctaacgaggatggaggggccataagcataggcaattattcatctgtctattttgaaaactgccacttcatatccaatgatgcaggagagaatgatggaggagccatatcaattggagaaaattccatctgcacaattaaagattctgttttcaagcaaaacaaggccgattccggaggagccatagtgaatgaggggactttaaagatcatgagttccaattttgaatataactcctctcaagtctttggaggggcaatctacactcatcattcaaaagtggaaattgcctattctgtctttaaaaacaatatctcctcttcaggagggggaatatatgtcctctttgattgtgacatgattatcgaagagtccctttttatagataatgcttcaatgtctgaagggggcgcaatggccaatgaatatggcggcaagattaggatacacg

SEQ ID NO: 900 - DNA, 1024 bp, Methanobrevibacter ruminantium
atgaggaaaaagatccttttcctaactttgatgatactaatctgttttactttaaacagcgtttgtgctcaaagtttggataatattaactacgctaatgatggatttgacagtgatgagatgattaattgtgatttacacaaagattcaagtcaaaaatccctgaaatcaaatgctttaagcaataagaaaacaaccaatactgttaagttaacagatatgaaaaaagctgaaagcaatgatgttaaacagacaggcgctgcaaaagcaagcaatactaaaagcacaagcaaaagcacaactaaaacaaatgctacaaaaagcaatactactaaaagtaccgctacaaaaacaacagcaaatagttctagcactaagaaagccactcaaaacacaactaccataaacactcagactttagcaaaaagctcaagcagttatatggcttatgttgagaaaaacgctaagctacaggaaccaattacaatcagcaaaaagaaatacaaatctccggaatatttgtatttggtttctaaggctgtaagcaatatttccaaaacaaaagtggaaattaaagataagctaatcacaaattacagcaatactgactgtaaatcagttaacggaactataaataaaactgaatatgtacaagtagctaagaaaacagttagcttcattgaaaagaatcatagagctcctaattggattgcatcatctaaaggcaatataccacgtaaccaattgattttggtatttagcaaatgcttagaccaatataacaaaagcggcaaattacctagctccattaagttaaatgacttagatttaaacaaaatgaagcaaaagattgacagcagtaaaaaggtaaacagtaccagcactaaaaaaaccaacacaagcagtactaagacaaacagtacaagtgctaagaaaaccaacacaaccagtactaaaaagaccaatcctactgcaactagcactaacaataacaaaagcttagtcgaaagcactttagattcaa

SEQ ID NO: 901 - DNA, 1024 bp, Methanobrevibacter ruminantium
atgatagcgggggtatctgcaagtgatataatggatgcatcagataatccaaataatgatgattctattaatctagtatctcaagagtctggtaatgatcaaatatctaatgaagccatttcagtttcaaatagtcttagtgctaatgatgattcttatagtccggaatctgaaaagataagctctaaaataaagacttcaaataatttaagtgcttcaaacagcacaaaaaccactactaaggccgctgcggctaaaactactaaaactggcactagtctacaaccatctagcaccagtatatattcaggccaatatcttgtcatcacattaaaggacaagaattccaaggctttaagtggtcagaaggttttaattaacatttccaaattcaaaaacacatatacaaaaactacagattccaaaggccaggtcaaattggctgtaaatcctgttggaagctttaagttagttgtttcatatgctggaaatggaaattattcctcttcaaagtattccggaaccctaaaggtttcaaaaagtgatacaagtctaacggttgcaagcacttccgttactatgactactcccttagttgttacattaaagaataaaaagaccaatgaggccttatccggcaaaaagataaagttcgttatggatagagtaagctattcaagaactaccgatgccaagggtcaggcaaaacttaaggtcaatatgaaatatgtctttaatgtcacagttaaatttgacggaacaggcaatcttaaatcttctaaggtgaccaagaccattaagcctaccaagattccggtaagctttgtctattcagcaaactctgtgaaatatggccattccataacagtcagtttaaaaaataatttaaacaacaagactctctctggcaaaaagattgtagtcaagactagcgactctaaaaagtcaacaacaaagactacaagttcaaaaggaacaatcagcgttcctatcaattctgtcggggatgtcactgtaagccttt

SEQ ID NO: 902 - DNA, 1024 bp, Methanobrevibacter ruminantium
ttgcttgccattccagcaggatttgcagcagatattgaatcaaatagccacaataatttagatgattcaaatacagtaaattttgaaattaatgcaaattcaaaggatacaaacttagagagtaatttaaatactggcaatttagaaatgaattcaaataatactaatttggatatgaattcaaataaggcaagattagcaatgaattcaaatgccagtgatttggaaacactaggtttgacaagaggggaatttgaaaacggatcaaacaatccaagcctagaatattcaagcaattcactctcagacaattcaaataataaatatatatccccatctagtgataaaaacacatatggctccaacaaggtaggtgacggtaacgtaaacatatactactttgatgctagtgctagtgacgatacaggtaacggcagcttagaaaggccttataaaacccttaaaaataatagaattgtagaaaactccataaattatcttgcaaacggagtatacaacctagatgctacaataaataaaaataatataagctttattggtgcagactcttcaagaacaataataagctacgcttcaactgcatttatcacaaacaatatcctaaactttgaaaacatcacattgaaaggattaaacattcaaaatagaggaaacctaactgctagaaacaccattttcataggtggaaaaggatattgggatagatcttacaacaatattttcggaggggcaatatatacaccccaaaacgaaaattacactacaataatcattaactgcagcttcataaacaatacagcagattatggaggagcaatctatgcatgcggcggaaacgtgactgtagaaaactccagcttcataaacaacactgccgaaaggtttggaggagccattgcctctgaaaataccttaacaaacaatataagaaatgtcgaattcatccatgacgtttcactaaacgatgcagggggaggactattcatatcattcacccaattaa

SEQ ID NO: 903 - DNA, 1024 bp, Methanobrevibacter ruminantium
atgagattaagatattttgcaataattagtttaattcttttaatatttttagttccagttagttttgcaagtgaaactaatctggattcaatagaattaaatgatttagctgattcttctactgaaatagatgattctactgatttaaatcaggattatagttctaatcaagatttaagtcttaatcagaattctgattctaatttaagcaatgaacaagaattatattctaataaacttagtgaaaactctctagattcaaattcacaaagttcaaatgatttatcaaactccttatatttgtcttcaaatggagtaaggctagctgatttgaattcaagctttgcccagttcaatacaagccttaacgattcaaatacgatctatgtaaactcatcctatattggttctgatgagtttggaactcaatctaatccatataagacagtattggctggaataaatgctgcaactactgatttaaataatgtctatattgcaaatggggtttataatataaatacaacaataactgttttaaaatccataaatataataggagaaagtcttaatgttatattaaatgcttccaacgaaaacaatatcttatcagttaaaggaagctctgtagaggtctcaatattcaaccttacattcaggaatggctatgcaaataagggaggggcaatatatgtggataaatcttccctaaacattattggaagcctttttgattcaaacattgcatatgtcacaagcgataacggatatggtggggctatctacaataatgcaggctttttaaagctctataacaccacattcaaaaacaataaggtggtagcagcatacaacatagtctctgaaggttttggaggtgcaatctataatgagcttggtgaaatgactgttcttaattctaagttctataataactcaatagacataagaaacatatcaaaatcatcatatggtgctggaggagcaatattcaaccgtgcaggatttgtcacaatattcaact

SEQ ID NO: 904 - DNA, 1024 bp, Methanobrevibacter ruminantium
atgtttattggcttattattaataggtctattaatcatccctataagttttgctggtgatgcagacagttattctgcatattctggtgattctattagtttagaggatgataattcttatttagaatcaaatacagttttaaaggattctaaaaattcattacaatctattgatgatgattgtttgattggaaataggactttagatgatacaagttattctgattcaactaattcagaggatttaacaaatcctgattcaactaatcccgattctactaattcagaagatttaactaatctagaaagttctgcaaatacagactcatcatctgaaatcaaaacaataacaaagagtctaaatgaccaaaatacaaacataaaaagcttaaattatgatgagtacgcagactacatcaatttaaacaatcagcttataaactacgactttgcaatttcagactcaaatacaatattcgtaaatgcatcctatacaggttcaacagagaatggaagtcaagcaagtccatataagtcaatctactctgcctacaattatgcatttggattgtcctctgatacaagaacaaatgtgtatatagctaaaggggtttacacagtaacaagaagaatgaccatcaacaaaaatctaaatctcattggagaggattccttaaatacaataattgattgcaatgggaatggtgcattctttattagtcctcgacggtcttatactacagtatatagcccattgctaaacatattcaatctcacatttacaaatggacgctattccagtggaggggcaatatacattaacgaaagtacagttaactttgtaaatgttatttttaaaaataaccgagcggaagcttcctattatggttcagtagaagggggagccctatataacaataaaggatttgttcgaatctacaactgcttatttgaaaataacactgcaaacgatacttcagatgcatgtggaggcgcaatatataacgatatgggtgagatgacaa

SEQ ID NO: 905 - DNA, 1024 bp, Methanobrevibacter ruminantium
atgggcatatttgataaggtcaagtcagcttttgaatctagtaaaaactttaaatatttagatgatttaattcatagcgggctgaatgagattgttttggatgatgatatcagcttaagtaaaaatgaaaaaaacaagtattctaacggcattgaaatagaaattgataatctggttattgatggaaatggccatgcaatagatgcccaaggaaatggttctatctttttatgcactggtaaaaatatcgtagtaaagaatattcattttaaaaatggaatccattccaatggaggtgcaatagaaaatcgtggggaattaactataatggattccacatttgatggaaataatgcatcccttggaggggcagtttttaacgacggccctaaactaatgatagctaaatccacaatcactggaaacatagccaaagagggcggcggagcaatatataataatgatggcgaggtttatatttcagaatccatgattaacgaaaatgtctctagttttcatcagtattctggcggagcaatttataataagggcgagttgactattgaaaaatcaacactcattagaaaccatgcaagttttggcggagcaataggaaatattggtcagttaaacataatcgattccacaattagcaataatgaatccagtggtgatggcggtgcaatttttaatgataatgctagcttatcaatatccaattcaatgattgaagctaatgtctcagatggattggaaggcggaggggcgatatataataaggaaggcgagcttaacattactggatctgtccttaaacaaaacgaattggtcggccaaataggaaaagggggagctatatataataatggaggcaatctcaatattgcaggttcatcactttgcaatcattccataaacttttttgggggagcgatatataatgatggaggcaagattaatattgcagaatccaaattcaatgaaaattcctctaacaggaatggcggggcaatatataatgaag

SEQ ID NO: 906 - DNA, 363 bp, Methanobrevibacter ruminantium
ttgctaattggacttgtcatctgtgcaggtgtcttttatttccaatttaactatgcaactcccacatatctgatattcaatgcaactgaagtcaatgagggaggctcatttacaggggtattgaatgatgcttatggatttccggtggtaaataagacaataacctatcataagccaggatatgaaatggggacattggtggatgttcaaacggatgacacgggagagtttgttatagaaaatgcccaatacctgccggatgccggtgaagacaattattatggtgcattcacctttgcaggggatggcaaatatcaaggatgttcctttgatggaaatataactgtaattccaaagaaataa

SEQ ID NO: 907 - DNA, 762 bp, Methanobrevibacter ruminantium
gtggttttagttgctgttgtagtgattggctctactgcattcctattaaattatgatgaaactgtaaaatacactacatataatttatccaaaacatgcatgatggatttgccatctggagacaattatgaaaataccactgttaatgaagcaattcgtcaaatcaatgatacaaaccgtgatttaactgttttattctataatagtgaagacaatagtactgtagcccgggtagaattcgaatttaccataaatgattttaaagccactgctactgaacagactgttgcaaacagaactgtctggtataacgaggaaaatggtacttatatggcatttttaggtaattcagttacccatgacaatataatcatcatcacaaatgatgttgagatattggaacatctcatatcaagcgtgaaatttattttcctaaatgaagacggcactgtaaattccacatctgatatggtcaataatcaaagcataaatgtcactggcggtacggcttcaaatggaactgatgcaagtgcatctacagctacttccaatgtttcaagctctaattcccaatctacaggcaatgatggatattattggtctggacaagatcaggattatattaaggagtataccgacagcaatggcatacagcatatagaccgtaggaacggacctaatgaggcttatgatccaaacacccaaaggcattatactgatggtgtagaggatacagcagcttataatcaagactttaattaa

SEQ ID NO: 908 - DNA, 948 bp, Methanobrevibacter ruminantium
atggataaaaaaactctagcaattattgctattatcgttatagctcttgtagctgttggtgcttactttgcaaccagcggtggatcaagtgacaatgtagtaagaatcggtcacttgccatcagaccatgacaccgcacttttcgttgcaaaagagaagaagttgtttgaagatcaaggtctcactgttgaactaactcaatttaacaatggtggagacttaatgactgctatggcaagtggagatattgatattggttatgcaggtatcacccctgtaatgtcttccatttcccaaggagttcctgtaaaagttgtatccggtgctcaaattgaaggaagcgctatcgttgccaataagaacagcggcatcactaccgttgcagacttaaaaggcaagactgtagcaacccctggtgaagcaacaattcaaaacatgcttttaacctctgctttaacacaagcaggcgtatccactgattcagttgaattcacaaccatgaaagctgctcaaatgactgacgctttaaaggcaggtcaagttgacgcaatgatcatttgggagccatattcctcaattgcagttaagaatggtgacggcgtattgattgaaaacagttctgaaatcattccaggacacccatgctgttgtgttgtagctagggaagacttcatcaaggaccaccgtgactcattagacaaggtattgaaagctcatgaagaagctactaaattcactaatgaaaaccctgcagaagcggctaagatgttacctgaagacatcgtaccagatcaagagttacaagctaaagtaatcgcagataccgttttcatttctggtttagatgctgagtacaaacaaaaggtcatggacttcatggctcttgaagtgcaattaggtcttttaaaacaacctttaactgaagaacaaatctttgcagacttatag

SEQ ID NO: 909 - DNA, 1024 bp, Methanobrevibacter ruminantium
atgaataataagacattatttatcattggtttattcatatgtcttttatttaccatacctatggtatcagctgcagatgctgattccaatttaattgataattcagtaattggaacaaatatcaattcacaagcaattacaacatctgatgcaagtattgatcacagttcaaatgcaaatgcaatcaatactaatattaattctgatgatattgtttctaataacaataacaataattccataattgatattaatgattccgatattgaatctcaaaaggatggttcaagtaagaatattatcaagtctaccaataaaaatacaaatgattccaataatgaaactgaagataatattctagtaactgatatcaatttaggtaaaaataataaaaattcaaatgataaaaatattttaagtgcaaatgcactaactgctgatggaactggtacaactttcggtgacttgcaatatatcattgaccaagatacaaccggtaccattactttagataaaaattataaattcgaatctggcactgatgatgcttatctcgatggtataactataaataaggccattactataaatggtggaaatcatactatcgatggagaccacttggctagaatatttaatattaatactggatctgcttccgatattgttgttttaaatagcatccatttcattaatggtatggcagatggcagtggcgataatgccaatggtggtgctatttatattggttctccaactaccttaaattatattactgcaatcaattgtacagctactggtaatggtggtgccatatatgcacatgcagatggtaccaatattgcagctaattacctatacctatataacaacactgcagtgaatggtggtgcattatatgtttatggtaatgattatacagtcacagtagtggatgcccgatacaattctgcaagtggaaatggtggtgcaatgtatgcatacggaaacagtttccaccttaacaaggttaacttcattaaca

SEQ ID NO: 910 - DNA, 1024 bp, Methanobrevibacter ruminantium
ttgttcaaggttgaaccagcctcatcaaatgtgactgtcgaagcggtaaatatcacttatcttgataatgagactatcactgtcactgttccaatcactaatgcaagcggtacagttgtaattaagataaatggaactcaaaaagacgaaagaaccgtaagcggagacaatccaacctacaatattacagtagggggattagctgttggcgaatataatgtgactgtagaatacagcaacgaccctaactacaacagcagcaatgcaagtaccttattccatgtagataaggctaatattcctgatgtcaacccagatacaggcatagttgttgttccaacaaatatcacatataatgatgatgaaactatcactgtaaccgttgatgttcctaatgctactggaaatgtaactatcagaatcaacggaactgatgttgaattgactaagaacattactgaagatggctcacaatctgtaacattcaatgttcctggccttgttgtaggtgactataatgttactgtagagtacacagatgatgctaactataatgacgtcaatgcttctgcattgttcaaggttgaaccagctgcttccaatgtgactgtagttcctacaaatatcacatatcttgataatgagaccattacaattagcgttaacgtaactaatgctacaggtactgttgtagtcaagataaatggcacagaagtgaacacaactacatttacaggtgaagacaagccaactattgtagtaactgttccagaccttgcagtaggcgaatataatgtaactgtggaatacactgatgatcctaattacaacaatagcgatgcatctgccttattccatgtggataaggctaatattcctgatgtcaacccagatacaggcatcgttgttgttccaacaaatatcacatacaatgaagatgaaactatcactgtaaccgttgatgttcctaatgctacaggtaatgtaaccattaagattaacggaactgatgttgaattgacta

SEQ ID NO: 911 - DNA, 246 bp, Methanobrevibacter ruminantium
atgataaaaacagacaataaaggacagataacagtcgaactgctccttcttttaagctttacattcataagcatcatagcccttacaaacatcataagcgatgcaaatgaggtaaacaatagccatggctgcagcaagaaaacggagcattcgaaggagcttcctcaaacggactggcaatctatccaaaggacacctttgacaactattcaaaggacaagagaaaggaaggcctattcaatatga

SEQ ID NO: 912 - DNA, 1024 bp, Methanobrevibacter ruminantium
atgttaaatagaaaggctttgattttttcattgattgttttatttatgctatccatttctgctgtttcagcttcagataatacctttaatgagggcactggtttaaatgaagatattgctgatttaaatgatttcagtgatttaaatagcaattttaataatggacttagttctaatgctgttcatggtctagatgatgattctaataataatttatcatctgaaaatatgatttcttcatctgatgatgaaaaacaagatgatttagagggttctgattcagattcaattaaagacaatctcaattcaaattctatcaaagaccaaaacaattctaattctagtactgcagacaagtccaatacaaaaatccaaactaagatctctgcaaaggacatcaatacatactataaggaaaaatcaagcctagtattatatttaaaggataataaaaatcaggccctttcaaacaagacaatcaaactaagcctcaacggtaaaacatatgctcaattgacagataaactgggaaaggcctcattctctctttatggccttaaacctaattcatatgatgcgaagatagaattttatggggatgatgattataagaagtctgttaggactgttaaagtcaatgtaaagaaggtagatatatcaatcaatacaaaggacttctccacatatctcaattcaaacatcttcttttctgtaaaggtcttaaacaagcttactaaaagtcctgttgaaggcatacggattcagttcaatgtttattcatcacagaaaaactataagaactactatgccctaagcgataaggatggaatcgccaccttaaagaagaacctaaaactaggctcatatgatgtttacacatatgtaaaggatgatggccaaaaggactatataaattatagaaacacaaaaaataaggtctcaattaagatatccgctcctggagagatgggatgctcatcaatctatatccatgtaaatgagaatgaaagcgctgtcgccttta

SEQ ID NO: 913 - DNA, 399 bp, Methanobrevibacter ruminantium
atggataataaagcgataattggaattgtaattgcattgattgtaattgtccttgcatgctttgcttatgtgacatttaacggaaatgctccaatttcattgaatgtaactgaaaatataacaaacaatacagatacaagcgtagacactacagacaatgccaccctcgtatcacaagacccaaataatgattctgaagttaaggacattgctaagaatgtctctgaaagtatatcagagcaaaataaggcagttgccgattctggagacaccttgcataaacagactttcacagtttcagaaaacgaaaccggtcaaaatgagggcatggaacctggaacctatgtgatgtattatactgaaaatgatggtcctataaaagttcaaaagatagattag

SEQ ID NO: 914 - DNA, 185 bp, Methanobrevibacter ruminantium
atggattcgagcgatttaaataagaatataggcactaatttagaaaataactttaacacagattcaaacaacaatttagacagtaatttaaactctaattttaacagcaatttaaacagcaatatagataattccacccaagaattagacttaagcactaaaaatttcaaagccctaagctctaa

SEQ ID NO: 915 - DNA, 1024 bp, Methanobrevibacter ruminantium
atggatggatcttattccaatctaacaaatctaaacttttatacaaatgcaacaagtgagaattccaattatcttacaccaatctacatcaacgaggcatcagatttggtcattgaaaacaacccaatttatatagactattctgatggatgtaactacaatctagcgggaatctatgcatttggtgcatccaataataatataataggaaataacagaatatccatctattcaaggtctctaagcaatacatcaaaacattacatttatgggatagacttctcttcatattcctcaaatgcctattctaaagataatgcgaagggaaatgacatatcatcaaatacaatagatatcatttctgactattatgcaaatgcaattacattgtcctgtgcagttgacaccactcttgaatcaaacagcctccatttaaaatcagattcatttgtttatggtatggttgcagagtattttgactttggaaatggtttgaatccatcaaataactttaattttacaaaaaacactattgaagctagctcaaatatggtatatgccattcaattctttaatgtatttgatgttaatattaaggaaaatacaatcaaaaccaattccaacggtagttatgggataagtgcatatgagtcttataatcatgatataggatataacaatctttttgtaaatggaaatgacgtttcaatgattggaactaattttgatgccataggaactggccatagtggaatatactatatgagggattcacatgatttaagcattcatgacaataatgttttatccaattactctcttgggggagattatgcaatcaggttcgatgcaagctccagcgagaatataaatgtttttaaaaataatttaagttctaataatggaaagtatctaggaaatgatgcagttaacggtaatgtgactgtttctgaaaacaatcattattatggagataatgatcttggcactaatgatttacgtatttttgacatctatgttgatt

SEQ ID NO: 916 - DNA, 1024 bp, Methanobrevibacter ruminantium
  modified_base (134)..(217): a, c, t, g, unknown or other
atgagttattttaataaaggacatatatggaatattttattaatttgtcttctcatcggaactttggctatgatgggttcagcaagtgccagttctgctaatttagatgattttagcaatcttgcatgtgactnnnnnnnnnnnnnnnnnnnnnnnnnnnnnnnnnnnnnnnnnnnnnnnnnnnnnnnnnnnnnnnnnnnnnnnnnnnnnnnnnnnnctaattcatataatgatttaagtgttggctttgaatctgatgctaattcatataatgatttcagcacctattttgaatctgattctaattcatatgatatttctgatagtttggttaattctaattctgatcgtttggttaattctaatggcttaattgagttcaatatttctgctcctaatgacattcaattaaatgacaaagcacctataaaaaactctttaaaagaatatgatgaaagggtattttatgtttctttagatggtaatgatttcaataatggattaagtcaagaaaattcatttaaatccctaaataaggctttagaaaatcttcatgatgctaataaaacaacaatatatgtttttgaaggaacttttctaagtgaaaatagctacgatctattctttgaaggggttggaaatagtcagatgatttccattataggttctggggtaaataagacaatattggatggtgaaggtttgcataggctatttaatgtggataattctatcaatttgacattaagggatttgacctttgtcaatggttttgacttttcatctggcggagccatttataataagggcaatctgactttagtcaacacttgcttttataataataatgtctattctgaagatgcatatcagcatgtgtctctgcttagcggcggagctatagaaaatgagggattcctgacaattgaaaactcttcattcattaaaaatagtgtgggttctgtttttaatcaatatgcctatggaggagccatttgcaatcatggaaacttaactataaaca

SEQ ID NO: 917 - DNA, 1024 bp, Methanobrevibacter ruminantium
atgaaaaacaaggcaatgtttttaatatctgcattattgatagcagttattctatctctcagtgctgtaagtgctgcagatgatgctattgctgcagatattgatgacattgacgattcaatcgaagtatcttctgtagatctctctgcagacacagaggatataagctatacggacgtctcttttaatacaagcaaggataagaatacattatcctcaaatattgtagaggagggagatggttcatggtatgtagacagtaaggttgaaaccactggtgatggtagtcaatcaagcccatataagaccataaaagaagcatttgatgcgtctggtggtaatggtactatctatttggcaagcggtgtatataacaccaccaatgataggagtttttcattggctttggattcaggtaataatctgtccattattggtgctggcagcgatgagacattaattgatttattatctctttcaaataattttataaacgttagaaatggaaataacttctatttgtctaatgtgaagcttatacgttctggaactactgcaattagtggagccaacataactatagaggactccgtatttgccaattcttattattacggcggagcaccgattttgtctttaggtggcggtgacaacactataagaaattgtgtgtttgttaacaattccgctggaagctggtatgggtcaggtgttgcaattttaaatggaaatgcaaatgtattatttgacaattgtctatttaagaataataccaacactaacggaggttcagtattctataccacttcatctaatatcaagttgactttaaacaattgtaatgttacagaatgtcctgtagctttctatgcttcctattttggaaatgtggtatttaacaattcatatttctataataatgatgtgacacgtttaaacaataggtattgtgccgttttctattcaaccgatccaggtaatctaactatagattactgtaaatttgaaaacaatacaggagtcg

SEQ ID NO: 918 - DNA, 414 bp, Methanobrevibacter ruminantium
atgaaatttaacaagagtttaattgcaatttttgtaattttgattgttgctttcagttccatatctgtcattgcagcggaagatgcagaagatgacaatccttatcataatggtgctgtaatgaatgaacaggaacctggatctggtgaagatgatgacaatccttatcataatggtgctgtaatgaatccacaggaacctgaatctgaggatgatgacaatccttatcaccacggtgctcttatgaatccacaggaacctggttcaacagatgattctcaagcagcaggttcatctcaagcagatagttcaaataaagtagctcttagcaaatatcctactggaaatccattagtagttttattaatgtccctttccatcattggacttggtactttaagagttagaaaatag

SEQ ID NO: 919 - DNA, 1024 bp, Methanobrevibacter ruminantium
atggataaaaaaattattatcggtgcagttgttgcacttcttgttataattgttggtgctgctgtcctcatgggaggaggcactactgaaagaggtcctggagaaatcgtagttgcagcttacagtcacggaggagaaccagaagctggtttcgatccaattgcaggttggaactattatgctgagccactcattcaaagtaccttattgaaaatgacccctaacggtacttacgcaaaagatttggctacagactatgagattagcgatgattataagacatacactgtagacttaagaaaagatgtcaaattcactgacggttctgacttgactgctgaagatgtagcattcacatacaacgcagctaaagaatctggcgcaagcttagacttatccgctttagataaggctgaagctcaaggtgattacaaagtcaaattcaccttaaacaaatcagattccactttcttagataagatggcttacattggtattgttccttccgattcttataacaacgaatcatatggtgaaaacccaatcggttctggaccatacaaattcgtacaatgggacaaaggtcaacaagttatcttagagaaaaaccctgattactatggtaaacaacctgaaatcgaaaagataaccattctctttgctcaaaacgaagctgcgttcaacttagctaaaaacggagaagctgatatcgtagctgtacctctcgaatatggtaaagaaaaacttgacggttacacaatgtacttacaagacaccatcgacgttcgtggtgtatctttacctagtgtacctgataccggagaattatctccagatgacaactacacaatcggtaacaatgtaacctgcgatattgcaatcagaaaagcattgaactatggtattaacagaactgctttagctgaaggagcattaaacggattaggttatccttcctatgacggtattgctcaccaattaccatgggctaacaaagaagcagcaattgaagacggtgacgttg

SEQ ID NO: 920 - DNA, 495 bp, Methanobrevibacter ruminantium
gtggaaggtgataatatggtaaatataaaaactgttgcattagctgttatagcaatcatagttgttttattggctatatttgctgtttccaatgtagtgattttagctcaggatgatactgaagggggaattcctggagttgatatggctgctttatggagtttgaatggtggtttccaatggatatatcctggaagctcttttgaccctgaaggccgtactcttcacaatatctatatgcttgacgacccttatggcgaagttaagacaatcatgcagtacacatataatgtggatcctcatattctggttataataaacgaccaggctgctgcccatatatttggggacaatatattggatacaatccgtcagcatgattgggtcgaaggccattcccgtggagatgccgttggaatgagcataacctctgtaaatcctttgccgataattccagacattttaatgggaaatattaagataatgttcatctaa

SEQ ID NO: 921 - DNA, 1024 bp, Methanobrevibacter ruminantium
atgaataaaagcaaaaaaactatgattatgctgattatggcaattcttgttttattgaccatggccagcgtaagtgccagcgaacttgaagacattcaagtcacagcatccaatggcacatcagatgccgttattgcatctgaagcaaatagtgcatatcctgataatgccattatcacatccgaaaaggaaaatggcgatgagaatattatcgcaacggataatggaaaaatcggatatgaaaatgacgataagactattatcgcaactaatggaaatgggggaaatatcggatatgaagatgacgataatactcttatcacatcagacaaagaacttaacgcattggataaaggaaaataccaatccctatctgtaggagactaccattcctttgaggaattgcagacaattctcaatcaagcggatggcggagagacaatagaactgaactatgactattcccttggagcaggaggatcaaccctaaagcttacaaagggattgaccataaacggaaataaccatacactatatggcgtagggcttgaccgcatactttacataagctccctcaacacccagccaatcatcctgaacgacatcatattcaaagacggcggaaaaaaggacagttacactaacctggaaaccaactggggaggagccatatactacaacccgacaactgaaggcggtgcaatcggcggcgaaccggccgattttatcataaacaattgtacctttgaaaacaatggagcagtcaacggaggaggagccatcttttggaacggatctctcaaaatcatagattccagattcttcaacaatgaaatcgaactgggaagcggaggcgcagtctatgcaaacggcaatttgactgctatcggttgctctttcagcaacaaccgcgtcagacatggacttataggaatggacatgctaaccacaacctttacagatgaaggatattgggcaaaggtaattcaatactacagtttctatagtgtcgatgtaattcccc

SEQ ID NO: 922 - DNA, 555 bp, Methanobrevibacter ruminantium
atgacaacaactgcattcgacttcaagatagagggaagaataggaaaatacttctacttccagcttcttgacgaatacggaaacccagtagcaggcaagaacgtttcaatcggattcagcggaaggatatataaccgtacaagcaacgagaccggatgggcaaagctgcagatcaaccttaaatattccggatactacacatttgcagtaaacttcggcggagacgatgaatatgcggcagcattcgatgttgcggcaatcaacgtaaccatccagacccctaagctgaccacaagcagcaagacatacaaggcaagcgccaagaccaagaagcttactgcaacattcaagagctataagggaactccgattccaagcaagaagattacctttaccataaacggcaagaagtacactgcaaagacaaacaagaaaggagtcgctacagttaaggtaagcctatccaagaaaggaacctataagtttacagcctcatttgcaggagacaggacatacaagaaagtcactaaatctgcaaagctgaccataaaatag

SEQ ID NO: 923 - DNA, 366 bp, Methanobrevibacter ruminantium
atgaataacactactaaaatattaattggagttcttatgggactgcttatcgtaggtgctgcagtaatgtttgtatcagcaactgcaataaatgatgtatctgacggaaactcttttatgggacaagtacaaaatactgcaaatcatgtgaagaatgttgcttccaatgacattaaaagtggcagcaacatcataggtggaggatctgaattcaattctcaagaaggaaatgggtatttttatcaaataaattatactgatggaaatttccgccaatatgatacaaaaacaggaaagcttataggttcaggctttaatgaagatcaatcaatccttggcaatgacgatggatttaatttagaataa

SEQ ID NO: 924 - DNA, 1024 bp, Methanobrevibacter ruminantium
atgggttcaaaaaattttcaatatctggatgaattgattcacagcagtgcaaatgagattattttggattcagatattgtattagattttgatgaagaatctgaatatgatgatggaatcaaactggatgttgatgacttaactattgatggaaatgggcatgtcattgatgccaaggatgggctgtgcagattaaaaaatcatgcgaaaaacatcacatttaagaatctttgctttaaaaatttcaaatccaagtttccaatatcaaatcaatctggtgatttgatatttgagaattgcagatttattcacaatcaaggtacaatctataattattttggaaacatatggctaaagaattgttgtttttatagaaattacttatcaaggtcctcttcaggatattcagtatgcatctataatgcaaaggattccaaggcattcgttagcgattctcatttttatcaaaatgaggttaactatccccattatgggctgattttaaatgacgggcttattgaagtcaagaactctatctttcatgagaacaagggtgaagattgtgaaatttgtgtgatttttaaccgaaagggggaattgcttgtggataactgcaaatttaaagacaataaaaatgtatattgcagttatgattttgcagaattgattgtttccattttaaatgaggcaggaaaggtttccttaagcaattccacttttgaaaatgaaaacagaatccttggttcaattaaaaatatgggcatttgccgtataatcgattgcaaattcaaagatagtctgatatataatagtcagtggtattctagcgtttcccgtcctgatgaacttgattttggcccatatctggaagttgaagattcaagtttcgccaataaatatgatgagggagtcattgcaaacagcggactttgtaaaatagcttcatgcaatattgatggaagatcatatttgaacaatgatgatgttctattcattgatgaaaaggactttaatttattaaagg

SEQ ID NO: 925 - DNA, 507 bp, Methanobrevibacter ruminantium
atggaaacagaaaatttaattattgtaattcttttagttttaatagctatggccggaattttctgtgcatttttatacacattcggtacaggaggcaatgatttagctcctgttgagccaaatctcacagctaatcaaactaatgttacaaacatgactaatgatactgctaacgctacaacagttgatgctcctttaaataatggggcttatggatccagttccatagacagttctagttctaatggcttgagtggatctaactcttataatggtggctctaacacctataatggcggttcaaatactaataatggcggttctaacaccaataatggtggatcttcctcttctgattctggtaatggcggttctgtcgctcctgattctggtaatggtggttcatcagattctggtaatggtggttctgtcgctcctgattctggtgggggcggttcatccagtggtggttctgaacctgcagccagtggcgaatcttcaaattaa

SEQ ID NO: 926 - DNA, 474 bp, Methanobrevibacter ruminantium
atgtttttggttatattattatttgcatttattgttataggaggatcttattcggtatttgctattgtttcaaatggcggaggcaataattctctctcttgggacaatattacaattgcaggtccttctggaaatgtaagcgatgatggcaataatagtgatgatggtttattaggcatttttaattccggcgattcttcagattcaagttcaagcaattcaaatactggttccagttctagtcagtctagttcttcccctgcgcgtagttcaagttcttctagttctagttctagtcagtctagttcaagtcaatctagttctagtcagtctagttcctctagttcaagttcaagttctagttctagccagtccagttctggttctagctatgattcaggctctggaggcagcgttgttgaatctggcggacattattatgatgtaaactctggtgatgagctcgattggtaa

SEQ ID NO: 927 - DNA, 1024 bp, Methanobrevibacter ruminantium
atggctttgcttattcttgcaatgtcatgtgtgtctgcaagcaatgcaagtgataatttggatgatttaaccatttcagacagtaattcactagatcttgtatctacatcaaattcagatattttatcttctgatagtggtgttagttctgatgatagttcaaatgatgcttctggtgatgttcttggttctgatgtatcaagcaatgaatcaaataatcagtctcaatctactttggattctaataatcaatctcaatctggtttagattctgataattcaacattattagattcacagtcaaataatcaatccaattcagaatcaagtgattcctctgatagttcagaaactgtcatcaaaaatgcaaccagcatatcagtttcttctaaaactgttgttagaggaaattctctcaatattactttaaaggataatgctagcaccttattatctaataagacagtcacatttaccttcaatggtaaaacttataataaaaccacaaatgctaaaggaattgctagcttaactcttacagcgactcctaaaaagtacttggtgaaaattgcctttgttggtgatgagctttatgaggcctcttcaaaatcagtgaatgtcactctaagcaagactccaaccagcatttcaaactcaggcaagtcaatagtcaggggcaaattatataagcttacattaaaggatgctaaaggaaaggccttatccggcaagaaaatcagcattagctttaatggaaagaaatataccaagactacaaattcaaatggccaagtcaacctaaccataaatgtaaatgtaggtaaaacttataaaatgacctataagtttgcaggagattccaattatctctcaagttcaggctctgtaagcattaaggtcaagatgggcacttccataatcggttccggatcaagcatcgtcaagggaaagtcctatacagtcaccctaaagaatgccaatggtgctgttttgtctaatcaaaagatagcctttactttaagcg

SEQ ID NO: 928 - DNA, 513 bp, Methanobrevibacter ruminantium
atgaacaataaatactttttaggaataattataataataattgcagttttagcagtgatatttgctttttcactagattatcaaacaaattatttgaatggaagttccaatggatctgtaaatactaatgaaaatagttcatttaatcaatcaaataatggtcttcaaacaaatgtccaattgacaatatctgccgaacagtcattcccaatggaaaaaatagctgaggaaattaaaacacaccctgcttatgaaggctacgatgaagatacactaaaatggctagaaacctttaatggaagcattatgtttacatcaaaggattattttgtagttatggataaaaatgatgcagaaaatctacctacaagctttgttaatgatgcatttatttatgatgacttcacatgcgatataattgaaaaacgttccttaggaaaggatttaaaagatataatatatgttaaaaatgttaaatttgaaaatcaaaggatagtgcctatgattttttaa

SEQ ID NO: 929 - DNA, 1024 bp, Methanobrevibacter ruminantium
atgcttttaaatgataaatctgaactattaaaatcattatctattttatttttgctaatagttctaattacaagttttaattcagtttatgcaaattcagataattttgatagtgctaaaagttcagatttaattttcagtgattctaataatgtttatatagaaaatattgattgttcggattctattttaattaatgtctattctaataaaaaggattctaatttaggttcctattttgtaggttctagttcagattcctatttaaaggattctaattcagattctgcatttgtagtttctaattcagaagattcctatttggaagactctaatttgaaccattctaagaattatctctctagccaatcattatcagcttctagcaagtcaaaggttattttgaccacaagcaatctaagtgctagctataagacaaagaatttcacagctaaactcactgatttaaacaaaaatccaattgcaggtgcaaaactgtcatttgtcattttatcaaagacatattacagaacaacagataaggatggcctagctagtctaatgattaatctggctccggggaaatataatatcagcactaaatttgaaggagatagcaattattcatctgctgtggttaaaaactccattacaatcagcaaaaagaagctttcaatatcaagctctgacttgtcaaagaaatatggggattcaaatagctttcaagtaaagataactgataacggcaatcctatttctgatataaaggtggctttaaagctttcagcaaagacatattataggacaagcgataagaatggcttagtgagcctgccaataaatcttataattggaaaatatattataaactcatctgtatatgataataagttttattatagcaatacaaattccaataatattattgtaagctctcaaaatccttataatctctctgtcttaaaatggggaacaaagggaaacattaaaaagaattctgttcttatgaataatattccaaaat

SEQ ID NO: 930 - DNA, 333 bp, Methanobrevibacter ruminantium
  modified_base (311)..(311): a, c, t, g, unknown or other
atgaaaaaaataattcttggaacatgtatcttattcttgttgattagtgtcgcatatgcaggaactgtcgatatattcacagccccttccccattgcaaccattaggcaatagtggtttcggagatggacaaggccataatattcaaatttttgagtttactgaaaacctttacaaaacctggtttgaaaatgataccgactatgttgtagaaaagtatgaaggaaacaatggtctttatttatatgccgatgatgaaaatgactgcggtattttagagattgttgaaaaggatggcaaaaaatatatcgnaaaatttccctgggactcctaa

SEQ ID NO: 931 - DNA, 678 bp, Methanobrevibacter ruminantium
atgaaaattaatttaaaaagagttattttgggaattattttgattttgatttgcatttcctcagcaagtatcatttcagcatatagtattgattctatggaaattcaaggaggatgcatttcaacaggaagcggattggaagataagacttatgcaaccatttatgtgggggaagaatacactggagcagatgttcttatacagatttattattcccgtgacggttcacagttaaaccctggaaataaggttccaaaaactgttgattctttaggttgcattgaagttcctagtgcaaatgcatttaaatattatccagaccttgctgagattaatctatatgattctgatggatatctgattgattcaagggatgtatccttatcaatccatagcggagaacaaacttttggagacttttatggttctagttcatcatcaagttcctattcaagttcttcatcaagcggaagttctagttcttcaggtgatggaagtacaactacctatcatagcggaacctctaatagctatgttggaaacagtaacactggaaaattccatgctcccggctgtgatagcgttgataagatgaagccttcaaataaggtttatttctcaagtcgtgatgaggcaataagtaggggttattccccttgtgggcgttgtagcccttaa

SEQ ID NO: 932 - DNA, 708 bp, Methanobrevibacter ruminantium
atgtcaaatgaaatttcacaaaacacagaaggaatatttttagtggttcctgcatataatgaggagcgaaccgtatcccaaatcatagaatgcattgcagagaggggatacaatgtagttctagtcaatgacggctctgcagacagtaccctcgaattggcaacagaatccaaaagaaagtatcctgataagatatttgttgtctcccatgtaatcaacagaggcttgggagctgccttaaagactggaatgatggttgcacttaataagggagccaaatacataataacctttgatgcagacggccagcatgaaatcagcgatattccaaatgtctgcaagcctttgcaggatggagaggctgatgcagtaatcggttcaaggccttttgaggacatgcccttgtctaaaagctttgcaaaccttgttatgaatgcccttacattcatattctatggaaggaatgttaaggattcccaatcaggattgagagcctttacagctgaagctgcagagaagatcgatgtggtttcaacaggatatggagtctcatctgaattcattaaggaaatcagtgataagaatctcagattggctgaagtaacaatcacaacaatttacactccagagactcaacataaaggtacagatgcaattgttggcttaaagatattaggtaaaatggtgattgacttatttagaatctag

SEQ ID NO: 933 - DNA, 1024 bp, Methanobrevibacter ruminantium
ttgttaagaggtagaaacatgggaatgaagaatctaattttatccaagagcgatcaattcaatcattacaaagataaggcaaatcaattgaaaaaggaaaataaggaattaaagctaaaaaatgaggaattggagtttaaaaacaatgagcttagtcctgaacttgaagagggaattagcctaatcattcctagctataagggagaaaatcatattcagcctcttttagagtccttggaaaagcaaacaatttcaaaagacctttttgaagtaatcttcatcgtcaatggagaaatggattccacaatagacatattaactgattttgcaaaatcaaatcctgacatgaacataataattagctatacaagcgaagggggagtgtccaatgcaagaaacattggaattcggattgcaaaaagggaatatataggatttcttgatgatgacgacttcatcagcgataattatctaaaagccctttatgaccatatagctccaaatagggttgtgctctctaatttcatcgacatcgatgaggaaactggagaagagatagggtctcgccttgtcccatattccatgaacagggaaggcatattcaatgatgttgttgtaaaactgactaacctttccatcataacaactgcaaagataattccagcattagccgttaagggaactgacttcaatccaaatctcaacaatggagttgacgtttcctattatgcaaggctatatccaaagaatcattttgaattttattttgtaagcaaggaagaaggagctgtctattatagaataaggcgaagcggttccatttcaagacaggaaacttcctatcaattcaatgtactggaccgattgaaggtcatcgatgacattaatgaaagctataaacaagttgataaaagcgatgaactctatgtccacttcctaaagatactctttgatgctcaaacatacttcattggattgtatttggatgaatatcctcaagatcgtgaaaaggtcattgaagaag

SEQ ID NO: 934 - DNA, 1024 bp, Methanobrevibacter ruminantium
atgaaaatattggtagtgcaggaatcagactggcttaagagaaaccctcatcagcagcaccatctaatggatcgcatggtgctacgtggacatgaagtaaaagttatcgattatccaatcgattggcctaaagaagactcaaaaggacttatctttcatagggaagtccacgaaaatgtctctaaggtaaagccagaggcagacatagaggttatacgtccttccttcataaaggagccagggcttaactatgcctccctatacttcacacataaaaaggaaatcaaaaagcagatagatgagttcaagccagatatcatcatgagcctagggcttctaaatgcatacacaggttcaaagcttgctaagcagcatggcattccattcgtatactaccttattgatgtgctatatgcacttattccagagaaggcatttcagtcattcggcaagaaggtaaacatgaaagcgatagagaactcagaccttgtaatcactatcaatcaaaagcttaaagaactggcaatggaactaggttcaaaaccagaaactaccattttgattgatgctggaattgatttaaatgactttgaccctcagcttgatgattccaacataagaaatatgtataatataagtgaagatgacacagtcctattctttatgggttggatctatgaatttgcaggaatgaaggagcttgcaatggagcttggaaagaataaggaaaaatatcctcatatgaagattctaattgtaggggacggcgatgcctatgataggatggtggagataaaggaggagtatgatcttggtgaccaattgattctcactggaaagcagccttatgagaggatacctgaatttttagcctctgcagatttctgtcttcttccggcttatattgatgaggaaatcatgcaggatatcgttccaatcaagctttatgagtatttagctatggaaaaggttgttatagcaagtgagcttccgggcatttccaaggagtttggatatggaaatg

SEQ ID NO: 935 - DNA, 996 bp, Methanobrevibacter ruminantium
atgtccaaatataacgaatatcaagataaaactattttagtaactggtggagcaggctgtgtaggcagcaacttaactagaaaattagcagagcttggtgcagagaaagtgatcattttagataatatgtcctctgcatatgaatggaatgtgccaaccaacgaaaacgttgagcttattcaaggggacatccttgatgatgaggagttaaagcgcgtatttaagatgaagccggactatgtattccatttggcagctcacttcgctaatcaaaacagtgtggacaatccggaaaccgacttgatggttaacggcataggcattctaaaggtgcttcaatatgcacagctcactggtgttgaaagatttgtatactcatcctctggctgtggagtatatgggcttgactctaagatgccttttgaagagcatgacatatccatttccttgcacaccccatatcaggttactaagcttcttggtgaattatataccaattatttccataacctatatgacatgcctattgtaaatgcaaggttctttaatgtattcggcccaggggaagttccaggaaaatacagaaatgtaattcctaatttcttctattggtccatgaccaaacaggcattgcctattacaggagacggaaccgaaacaagggactggacctttgttggagatatcgtcaacggccttttgtcaatgggagttgaagaggaagcgataggtgaagcgataaacctaggttcaggtaaggatcacagagtaattgacatggcaaacaaggtcaaccaactcactggaaatgaagagggcatcgcctatgttgcaagacgtaactgggatgctaagaccaagcttttatcttcaattgataaggcaaaggacattcttggttataagcctaccgtatcctttgatgatggtttagaaagagtttacggttggtttacagacaactgggaagacattgaaagagatgctgaattttaa

SEQ ID NO: 936 - DNA, 936 bp, Methanobrevibacter ruminantium
atgaaggataaaaacgttgtagtaacaggagggcttggatttataggatcccacattgtagatgctcttatagatgacaataaagtcacaataatcgacaatctatcaagcggtaagatggaaaacctaaacaatccgaatcacgagaacttgacaatcatcaaagaggacttgatggacgcagacttagaaaagatattaaaggataaggactatgtcttccaccttgcagcacttgcaagcgttccaggaagcgtagcagagcctttaagatacaatcaaaacaatattgacgctagcttaaagctatttatagcctgcaaaaacaacaatatcaaaaaagtgatcttctcatcttcctctgcagtctatggggaaaatccaaacatgcctcttaaagagagcgaaaacttccttccttgctccccttatgcagcccaaaaggcaagctgcgaactatatttaaagtcattccatgaatcctacggattggattatgtagcattaaggtatttcaatgtcttcggtcctagacaagatgaaaactcaccttatgctgctgtaattcctaaattcatatctgcaatccttaacggagaaagtccagttatttatggtgacggcgagcaaagcagagactttatttatgttaaggaaatagctaaagcaaatatcctctcagcagaatcagactacaatggagtcatcaatgttgccctcggcaagtcaatgacaatcaacaggctatttgaaataatcagcgacgttctagaatcagacattgatgtaaaataccttgatgaacgtccaggagacattaagcattcccttgcagacattagcaatttggataagattagtttcaagccagatgaggacaagtttgaagaacaattgagggaaactgtaaaatggtttataagccagatggaataa

SEQ ID NO: 937 - DNA, 681 bp, Methanobrevibacter ruminantium
atggcaagcatagtggctattatacctgcatacaatgaagaggaagctttggctgatgtgatagcaaagacttcaaagtatgtggatagagttattattgttaatgatggcagtgctgataggactgcagatgtggctattgaagccggtgcagagctaatcaatcatccgactaatttaggaaaaggagaggcattaaaatcaggttttgaggctattactgatgattcaatcattgtcacaatcgatggggacggccagcataatcctgatgagattccaattattcttaagcctatcattgaagatggagttgaccttgtaaatggcagcagatatttgtatggtcatgaggagaacactcctgcctataggagagttggacaaagggttttagacattgccactaatatctctgcaggaatcaaggttacagactctcaaagtggttttagagcattctctccaaaggctaggaattgctttaggtttaaagacactggttttggtatagagagtgaaatgctagtggatgcagcagaagccggtttaaaaatagttgaagtccctataactgttcgatatgatgttgatggctctactaaagatccggtaacccatggtgttggtgtattgcttaaaataatgaaagataaagccgttaggacttttaaaaaatag

SEQ ID NO: 938 - DNA, 972 bp, Methanobrevibacter ruminantium
atggaaactcaaaggattatggtaactggcggaagtggatttataggaacaaaccttgtaaatgaacttagatctagaggacatgaagtattgtctgttgaccttttgcatcatgaggatgaggctgatttgtattcagactcttacagtgattatgtaaggggagacattcgtaactatcgtcaaatggaacgcatcttcgatgacaatgacaaatttgactatgtttacaatttggcagcagaatacggcagatggaacggtgaaggatattatgaaaacctttgggaaaccaatgtaatcggtttgaagaatatgatccgtcttcaagagaaattaggatttagaatgatttcattctcctctgctgaagtttatggtgactatgaaggaataatgagtgaagatgtaatggaaaacaggccaataaaggacacttatcaaatgaatgactatgcaatctccaaatgggctggagagcttatgtgcatgaactctgcaaccatgtttggaactgaaactgtaagggttcgtcctgttaactgttatggtcctcatgaagcttactctccttataaaggattcattccaatctttatttataaggcacttcatggattgccttattcagttcataagggacataaaagaattattgattatgtggaagacactgcaaatacctttgcaaatattgtagataatttcattccaggtgaagtctataatgttggaagcaaacaggaatgggaaatgaccattgaagagtattctgaccttgtgcttgaagctgtaggtatagatgattccttagtgacctacactcctgctgaagactttactacaaaagttaagaccattgacttttctaaggctattcgtgatttaaaacacgatcctaaagtctctcctaaggaaggaattaaaagaacagtcgaatggatgaaatggtattacagaattgaagattag

SEQ ID NO: 939 - DNA, 543 bp, Methanobrevibacter ruminantium
atgactaataaaagtcctgaagaagagatagaagaattaaaggctcagctttctaaatatagaaaggaaaaccgtattcttaaagagagatgtgcctcctatgaagataggattgaacattttgctatagagcgaaaagagctgtctagagccatcacccaattcgaatcattggaattggagcttcgacaatatgatttggaggagctgattcaaaacacccgcaagttaaatcatagaatcgatattcttcgaagatatcttcaaacagagcgagaggacaatgagaaattaaatgaattgattaataagctaacaaaggaattggatgatgcaaattatgaaatatctcgattgactactgaatttcataagcttagggttcgcaaaaatcaaagaacctattttttagaaaatcgtttggatattgcatataccaaattggctcaattgaaatacaccttaaatgaatttgaggaacttggattctgggataggcttagaggcaaaaaacctgaaagttatgatgatattgacatttga

SEQ ID NO: 940 - DNA, 846 bp, Methanobrevibacter ruminantium; identical to SEQ ID NO: 776

SEQ ID NO: 941 - DNA, 975 bp, Methanobrevibacter ruminantium
atgattttaattactggtggagcaggctatattggctcccatattaataaattattaaataaatccggttatgagactattgttttagacaatttgtctaaaggacacaaaaaagctgttaaatggggcagtcttgtaaatgcagatttaagtgacagtgataaattaagagagatctttcaaaataatgatatagaggcagtaatgcactttgctgctttttcatctgttgcagaatctgtagaagagcctgaaaagtattttaaaaataattttgaaaatacagctaatcttttaaggattatgaaggagtttagagtaagaaaattcatattctcctcaactgcagctttatatggtattccaaaggagattcctataagcgaatcagctgaattaaagccaatcaatccctatggagagtctaaattaatggttgaaaacctattaaaggacgaatctgactttggaggattgaaatatgtctcgctacgttatttcaatgcagcaggtgcagatttggattgtgagattggcgaagatcataatccagagtctcatttgattcctttggtcttggatgcagcaattggaagaagaaacagcatttccatttttggtgatgactatgacactccagacggaacatgcataagggattatattcatgttcaagacttggctgatgctcatttaaaggcattgcaatacttagaagagccttttaatgacagcaatatatttaaccttggaaacggcaatggattttctgtaaaggaagtcattgacacttgtaaaaaggttacaggaatagactttgaagtgaaggtggaagggcgcagacctggagacccagatatcttaattgcagattccaaaaaagcagaagaagtcttaaaatggaaaccagagtatccagatttggaagacattgttgaatctgcttggaattggcataagaaacttcacggataa

SEQ ID NO: 942 - DNA, 201 bp, Methanobrevibacter ruminantium
ttgaccgtttccttcctatttgtcaatggagcagcatctgttttgctgaatgcaattgataaggaaaaggcagtaacaaaaatctatattatggcagttatatttaacgtatgtcttaatttggttcttattccaatgtttagttatgatggagaggcaatatccactgtattaagtgtgaaatatttattatcattttaa

SEQ ID NO: 943 - DNA, 114 bp, Methanobrevibacter ruminantium
atgattattattccacttagcataggtattttcttctatgcaaggcttatcattgactttatttacagcaaccaatactctcttgcatcaactcttattcaaataattgtttga

SEQ ID NO: 944 - DNA, 1024 bp, Methanobrevibacter ruminantium
atgaatcaaattaaatccatttttaaaaatactggttggttatctgtttcacaagtgataacaagcatttgtgcattcctatggaccataatcatagcccgatacctgggagtatctgattatggcattgtctcatttgcagtttctttcactggccttatgggaatagtgatggatttgggaataagcacatacatcactcgtgaaattgcgaaacataaagatttagtaaggaaatattttaacaatatctttttatttaagcttatattagccattatcttatttattttaagtggattgattttgtatgtcatgggatactctcatttaactataatagttactttggtttttacaatagaacttatcttcatgtctatgactacttttttaaatggagttttccaggcctttgaaaaagtaaaatatcaagccataggagctatattaaatagcagttttttattaataggcattctaataacattagggtttgatttgggcgttatatccattgcctttgcctacactgttgcatattcaatatatttttcatatatgtttttatcatatgttaaaacattcagccgacctcatttagaattggatacaaatttcataagggaagtaataatcaaatccattccttttggacttacaaacttcttctattctatttatttttcaattgacattgtaatgttgtcctatttggctggagattatgcaacaggactttataagtctgcatacaacataataaatgttttcacaacattttttgtagtttaccaaagcgtaatattccctgttatgagcaaattcttcaaagaaagccaaaatctaatcaaagttagctatgagctttctgtaaaatatttgttgttaattattattcctatcagcataggcattttcttctatgcaagaccagtggtggatcttatttacagcaaccaatactcacttgcctcaactccagtccaaatacttatctggacagtttcattcctatttgtca

SEQ ID NO: 945 - DNA, 777 bp, Methanobrevibacter ruminantium
atgctaatgtctataatctgtgtttataatgatgaagaggttttagaaaaatatttgttagaatcattaaaaacacaaaatgaagaatatgaattaatattaattgataatagaaatcatgaatttaattccgcagcttcagccctaaattatggtggaaaaaaagcaaaaggagaaatattgctttttgttcatcaagatgtggaattttatgaaaataacttaaaagatataaaatattactttgaaaattgtcaaaatctaggaattgctggagttcaaggagtttctgaggaaaactatgggagaattactacaaatatcgtctctgggattccaaaatcaacagtgtcagattatagtattacagatataaccgaaacccaaacccttgacgaactattgcttataattcccaaagaggtattcggaaaatatcaatttgatgaagaaacctgttatgattggcacttatatggagcagattattgtttaaacattaaacaaaaaggatattctgtagttttattcccaataacattatatcatgtatctgaaggaggttcaatgtctttagaatactttaaaacattgaaaaaagttttaaataaatataaatatgattataatcgcatatacacaaattgtttattaagtcatgaaccgaataatcagttaaagttggatatcctttactattctgaaattttacatataaggaatcccataactaattttttatcaaattttaactttctaaaaaaaatcttaaaataa

SEQ ID NO: 946 - DNA, 1002 bp, Methanobrevibacter ruminantium
atgcaaactgttggaatgattctttgtggcggttttggaaaaagacttaggccagttactgaaaaagtgccaaagccgttagtggaaattaaagaagattatgcaatacttgataaacaattatttgattttaaaaatgctggaataaacgaggtttatctattagcaggatttttacacgaaaaaatccaagaacgctatggtgacgaatataaaggcataaaaatcaattatgtcattgaagacgaacctttaggaacacttaatgcaatcagattaggtatggaagcacttggagaagataaacaagttgttattagaaatggagatatagttgcagacattaaccttaaaaagatgatagaatatggcgaaagatcagattactttgttacaatgtttgtcaccaaaatgacttctccatatggaattgtagacataagtggagataaaatcactgcttttaaagaaaaaccactattggattactatataaacggaggaatttacttcaccaaagggttattggacttcggagaatttaaaacaggtgatatagaaaaaacattattcccagtgcttgctaaagaaaacaaacttggatactacagggaagatgatctcttttggatggcaatcgacacatcaaaagaattggaatctgttcaaaaggagtatgaaaacaaaacagacaagccttggggatatgagaaggtcctcatttatactgacaagtaccttacaaaagagctttacttaaaagaaggatttcagacttctttccactatcacaatgataaggatgaaaccatgtacataatgtccggtgcaggatacatcgagtttgaagacaggaaagaatactttggaaaaaacgattccattcgtattaaacctggtgttgtccattctattattgcaactgaaaatacaacattacatgaggtttctacaccatttttagatgatacaatcagagtaaaagattattatactcgttaa

SEQ ID NO: 947 - DNA, 1008 bp, Methanobrevibacter ruminantium
atgagtgaaaagaaaaaaattaaagtaaaatttgttgattttcaagatagtctaaaagagaatgataatttctttatagacagtctaaaaaagaattttgatgttgaggtttcagatgacccggattatctcttttttggcgcttatggttacaaacacttagattatgactgtataagaatcatgtggactattgaaaattatgttcctgacttcaatatctgtgattatgcattagcttatgatatcattgaatttggggacagatatcttcgttttccatttttcttaaatcgtcctgaaattgaaaacgttagaaaaacaatagaaagaaaaccaattgacacaagcgttaaaactgatttttgcagttttgtagtttccaatgaatggggagacgattatagaatccgtctgttccatgaattaagcaaatacaagaaagtggactctggaggaaggtctctcaataatattggtggacctatcggcatgggccttgataagaagtttgaatttgatgtaactcataaattttcatttgctcttgaaaatgctcaaaacaggggctatactactgaaaaaatatttgatgcttttgctgcaggctgcattccaatctattggggagatcctaatattgaagaggaattcaaccctaaatcctttataaattgtaatgatttgactgtagaggaagccgtggaaaaaattaaagaagtcgaccaaaacgatgaactttatcatgccatgctaaatgaacctacttttttaggtgatttggacaaatatcttcaggattttgatgacttcttgtttaatatctgcaatcagcctttagagaaagcctaccgtagggataggataatgaaaggaaaaactcaagagcatcagtacaaattgattaacagattttattataaaccttattttttcttaattaaggtagcacagaaattacacattgaatttatcggaagaaagatttatcacttcattagagactaa

SEQ ID NO: 948 - DNA, 801 bp, Methanobrevibacter ruminantium
atgtcaagtcaaaatatccagatttatgttgtatcccatagtgaagaggatatcaaaaatattgattctaacgacatttacactcctctttttgttggacgtgcaggcaaggacaatttaggctttgtaagtgacgatactggagataacatatccaataaaaactcttcctactgtgaactaacaggactttactggatgtggaaaaacagccctgcagacataattggtcttgtccattatagaagatactttgcaaactggagacttggaaaaaggttagaacgagaagatattgaaaaaatattctctgaatatgatattattcttcctaaaaagacaactgctcttttaggctcagtatatgaagactacgaccattggaactatgctaaagacttggacctctgtgaagaggttataggcgaacaatgtcctgaatatcttgatagttataaacgagttgtggaaggaaaagatctctactattacaacatgttcatagcccctaaggaagtcattgctccttattgtgactgggtatttcctattcttgcagaggtagaaaaaagagtggacatgactggatatgatgattatcaaaaaagaatctatggattcttaacagaacgtctctttgatgtttggatggacaaacaaaacttgagagtaaaggaatgtgaactaaaagtcaatggacttaggcttaatgtccatatgtggattgtaaaaagaaagattgtaagatgggcttatgtccatatttatatgggcttgcttcataaggatatgagacgttaa

SEQ ID NO: 949 - DNA, 1020 bp, Methanobrevibacter ruminantium
ttgccttgtaatagaaaaagagaaagccatattggaggcaatgtttacacagaggaaaagcacaatataaatgtccataagtatggtgcgcatatattccacaccaacaataaagaggtatggaattatatcaatcaatttgcggagtttaaccgctacacaaactcacctgttgccaactacaagggcgaattatacaaccttcctttcaatatgaacaccttctaccagatgtggggagtgaaaactccagaggaggccaaggcaaagattaagcagcaaaaagctgaggcaaatattgatgagcctcaaaaccttgaggagcaggcaatctcccttattggccgagacatatacgaaaaattagttaagggatataccgaaaagcagtggggaagggattgcacagatcttccatccttcattatcaaaaggcttccggtaaggttcacctttgacaacaactatttcaacgacctctatcaaggaattccaatggggggatatactaaaataattgaaaagatgcttgatggaattgacgttgagctaaacactgattttcttgaggataaggataaatggatggctatggcagatagggtcttatttacagggatgatcgatgagtattatgactactgctttggagagcttgaatacagaggccttgactttgagtttgagaccttggatatggaaaactatcagggaaacgctgtaattaattatacagatagagaaaccccttatacaaggataattgagcataagcactttgagaatgcagtctctgataagaccgtgattactagggagtatccaaaggcttgggaaaagggccaagaggcatactatcctatgaatgatgagagaaacactgagctatttaataggtataatgacttggcagataaagaaggcaatgtaatctttggcggaaggcttgggatgtataggtactttgacatgtggcaggtcattgatgaggcattgaagttagttaaatctttagaatag

SEQ ID NO: 950 - DNA, 306 bp, Methanobrevibacter ruminantium
atgcgtttagaggttgtagataagtcagttacaaaaaatatcaatttcagattggtttatgattcaattaaagcatatagattgtcttcagagctttgtgacaatttcaatataaagaataaggacctgttcctaaacccttatctattaaactggataagcttatggctaagcagaaaaaatacaaaagaggaaaataagatatttttagaggaatttgataagttagataagactaaaaagtatggtttgaagtataaattgattttaaagaccacaaaattattattaaaaataaaatcataa

SEQ ID NO: 951 - DNA, 1024 bp, Methanobrevibacter ruminantium
atgaaaatagcaatggtaggtcaattcccaccccatatcggaggagttggagtacatatacacagcctagcaaagcaactaatcagggaaggccatgaagtatatgtgattacataccctcacaaggacattaaggacattgacggaattcatgtcattggaacaaaaggaataaatataccaggccttagaggattgatgtttggaattaatgccaaaaaagaattaaaaaagcttataaatgaagaaaacattgatataatccacggccattacctattccctgcaggatgggccagcgttaaggctggaaaatcaacaaataccaaaacctatgtgactgcacatggatcagatatctttgaaatgtataaaaaacaaaaatttatgaggccctttataaagaaagtgctctctgatgcagatatagtccttgcagtaagcaatgcattgaaagatgaaataataaagattgatgttccaggcataaaggaaaagattaagattcattggaattcagtagacattgaaaaatacaaaactacagaagagaataaggataagtttaaaaaggaactggttaatgaatacaatctagacccaaataagccaatgattctttttgtaggaaatataattaaaagaaaaaatgtgaatctccttgttgaagccaaaagactaattaaaaccgatgcaaatcttgtaattgttggagaaggttctgaattaggaaagttaaaggaaaaagtaaagaatgatgataaaatcaatgacgtttactttacaggagctagaagagatgtggaagacatctatccaagctgtgacttgcttgtactgccttcctttagcgaaagtttcggacttgttttaatagaagcattagcatgtggaaatgcagtcattggaagcaatataggcggaataaaagagataatcacagaagacgttggattattgattaatccaaatgatagccaagacctagccaatgcaattgataagatacttcaggatgaagaat

SEQ ID NO: 952 - DNA, 1024 bp, Methanobrevibacter ruminantium
atgaaaatagctattgtacttggaacaaggccggaaataatcaagatggcttctgttatggatgaaattgaaaacagaggtcatgaattgttattaatccacacaggccagcattatgataaggaaatgtctgaaaacttcttcattgacttgaaactacctaccccaaattataacattcatgtaggctccggctctcatggagctcagacaggcaagatgatggaaggaatagaagaggttcttcttgatgaaaagccagatatattgcttgttcaaggagatacaaatgcagtgcttgcaggcgcacttgtcgcaagcaaattgcacattccagtaggtcatgtggaagcaggcttaagatcatttgatgagactatgcctgaagagatcaaccgccttgcagcagacatctgctccaaattatactttgttccaacagaagaatcagcaatcaaccttgctatggaagggatttccagaaaaagaatcttcataaccggtaatactgtagtggatgcttgcttcaggaacctagaaatatccaagtctagagataaagaccaatatgatgaaggccttcaggaattggatattgacaatatggataatatcctcaccctaacaatgcatagggctgaaaccgttgacgataaggaacgcctaaccaatataattgaagctcttgaggaattaagcgacatgaacattatcttcccaatacatcctagaactaaaaagacaatggagaacttcaatctctttgacagattaaacgatctccctcatgttcatataatcaagcctgtaggctatttggactttttgcttctcatatccaagtctacaatcatcctaacagattccggcggacttcaggaggaggcaatcacccttgatgttcctgcactgaccctcagatacaatacagagcgtcctgaaacagtaactgccggagggaacatccttgtaggttccgataaggaagtgatacttgaaaatgcaagaaagatcttagatgatg

SEQ ID NO: 953 - DNA, 1024 bp, Methanobrevibacter ruminantium
atgtataaagataataaaatattagttgtaattcctgcaagaggaggatccaaaggaattccgcgtaaaaacatacgttttttaggtaaaaagcctctcattgcacacacaatagaaatgggaaaggcatccaaatatgtggatgagctagttgtgacaactgacgatgaggaaatcaagttcatcagcgaaaaattcggagcagaaacaatcaaaagggatggaaagctagctgaagactctatcccacttgatccggtaatctacgatgccgcaattcaaaaggaaggaaaaagcaatgaaaaatatgatgttgtaattaccgtacagcctacttccccattgcttaagacaaaaaccttagatttagctattgaaaaactattaaaccccgacaatgaaaacaaagattatgacacaatcataagtgttgtagacgacaggcacttaagctggggctatgatgagaaagaaaaaaagtatttcccattatataaggaaagggtaaaccgacaatatcttccaaaggcatataaggaaaccggaagcatatttgcaacaagaagagaatttgtaaaggaagatagccgtcttggagaaaatataggtcttattgaagtatccaaacaggaaagcatagacattgacaactatgaggactggtgggtagctgaaagaatcctaaacaagaagaaaatcctaataaaggcagatgcctcccacgaaataggaaccggccatatttacagaggcctctcaatagcttcaaagcttgtaaaccacgaagtgattttccttcttgatgaggctcaggaattaggaattgaaatagttaaaaacaacaactatccattcataacccataattccaataaaggaaagggtaaagaggcagatgaaaaagctaaggaagagattatagaaaagatagtggaatacgacccagacattatcataaatgacatactaaacaccaattcaaaatacacaaagacccttagggataatggatttttcatagtaa

SEQ ID NO: 954 - DNA, 840 bp, Methanobrevibacter ruminantium
atggaatcaaaagacattacaaatattgaagagattataccaagcaatgacgtatatcctttagtaaatctactattccaaagcaaactcttcaaatcaaaagaaataaacacaaacagccttgcaatcagctgtcttgacctaatcgacaaaaacagaataaaaatcacattcaatgaggaaatcgaatcaatcaaaatcagcaagaaccctcttcttaagacaaaaggccaattggaaaaagaattggaactcatgaaaaacatcaaatttacaatcaattcaaaagagatgaaaaaactggataaaagagaccaaatcatcttgaagatgtttaaggacatcaacaaaaaccatgaatttgacttaaaatccatgtatgataagatcctaaagcaggatatagcaatcaaatttgcaaaatacttcaaagattattccaaatcccttgaaagggaaaccaaatactcattggaaaactataaagacctcatcaaggatggagagtttacctttaagggaaatgaaataagcaatgaatggaaagaattcaaaagctctttaaaatcagataagtccttatacagccaagacgcagaaataattgacaaatatctgatttatggaagatgccttgaaattgaaaaggatgttctaaaaaacattgaaaaggcaaatccagactacgattcagagctttacagattcctaaggcataatggtgcagacttattgaagctaatatttgataaggcacttgcaaacagcaagatagaaagaaaaggagacggttcagtacctgttggaaacagcaaatacttcgtcccaggattcggataa

SEQ ID NO: 955 - DNA, 1024 bp, Methanobrevibacter ruminantium
atgaccatattcaatgaagaaccattcctaatagccgaaataggcgtaaactactacgacattgcaaagaaggaaaatatatccaatatggatgcagctaaactaatggttaaggaggctcatgacgcaggatgcaatgcagttaaattccaatcatataaggcaaacaccatagcatccaagaattctccagcatattgggacacaaacgaagagcctacccaatcacaatacgaactattcaagaagttcgactcctttggagaggcagaatatagggaaatcgcagactactgcaaagaaatcggaatcctattcctatcaacaccttttgattttgattcaatagactatctagacgacttcatggacgtttataaaatatcatcctcagaccttacaaacatcccattcataaaaaagatagccaataaaggaaaggacataatcatatccaccggagcatcaacccttgatgaagtaaaactagctatagaaacaatagaaaacgctaacgacaaatacaaaaaaggagaagctggaatcggaatcatgcactgtgtgctctcctatccaacagcaaatgaagatgcaaaccttcttatgattaaaaaccttaaggacctttatccaaattatgaaataggatattcagatcatacaaagccagatgagaatatgctcattcttacaacagcctatctttatggcgccactatccttgaaaagcactacacattagataagacacttcaaggaaacgaccactatcatggaatggacccagatgacattagaaagttcaacaaaaacatagaactgataaaaacaattaacggccaatatgataagatacctctcccatgtgaaggagaatcaagaaaacaggccagacgctcaataattgcaaaggaagaaatcggtgaaggcacaataatcacagaggatatgcttacatataaaaggcctggaactggcatttctccaagtgaaatagataatgtagttggcaaaaaagccaaaa

SEQ ID NO: 956 - DNA, 1024 bp, Methanobrevibacter ruminantium
atgacttttacagtaaaggaaatatgccaacatatctggtctcttgaagagaaatatgaactgaaccacaaagagattcaaggctgctatccatggcaattaatcagaatgtatctctactacgaaataaccagaaagacaaatgtctttgagtcagctcaacagtccagtctttccctagcggataaagtaaatacattccttccttttataaaaaacagcattctttcaaaccccttaagcggaaaggataccaaagatgttttaatattcgaccatccaagaaaagtcatattaaatggggaataccaagacatctatagctattttctaaaggacattctaataaaaaacaataaaagctttgaaacaatagaatccccatatctaaacaatcatttcagaagcagtgcaaataagaaagaaaataatgtcaaatacaatgaccgaatccttttaggctcttttataaacaaaaccaaaaatagaggaaaattgccatttacagatgaagaaaaagactttatcgaaacaataaaaagagaattagagtctgcattcaaaatagaaataaatctattcaatattattgaagatcacatacttaatttccaatatgattataaaaaatatatagagcttcttgaaaagagaaagccaaagcaagtctatctggttgtagcctatgaaaacaaggcattagttgcagcatgcaagaaaaagaatatagaaattattgaattacagcatggaaccataagtccataccatttaggatatagttacccaaaaaatacaatgctgatgaacaatacaatcaaggaaattgaatatttccctgataaaatactaagttttggtgactactggcaaaattcttcaagcttccctatagaatccgataagataatctcaatgggatttccatactttgaagacaactctaaaacttttatgaagatggcagatgaggataaaaacaaaaagcaaattctattcatttcacaaggagttattggaaaat

SEQ ID NO: 957 - DNA, 1024 bp, Methanobrevibacter ruminantium
atgtgggctcaagtaaacactaccatcgcacttgttccaaacatagccaacctaggtcttccatacaccatggtacgattcctgtctgctgaaaaggataaggaaaaaataagagattccttctatccaatgataagcctgacattcatatcaacagtgatcatctgcctattgtttttaatatttggacaccctattgcagatgcgctctttaatggaagcatgcaggtattgtacatcacaactgcaatatccttctttgcatgcatgaacctaatgctcataacctactttagaaccttccaggaaatgaaaagatattccctattccttgttcttcaaagctatataggggtttttgtaagcatctaccttacatatgcaggatacaatatagaaacagttgttctcggtcttttaacaggctatgcagcagtattcatcatgatggcatttctcattgtaaggcatcttggattcagctttggaaaatggtcaaacctaaaggaacagcttgcctttgcccttccaaccattccaagcaatgtttcaagctgggtagttgattcaagcgacaaatatgttattggaatccttttagggtcagtggcagtgggatgctattcaccaggatatgccttaggaagcatattgctaatgttcctatctccatttgcagttcttcttccaacgattcttccagagcattatgaaaagggagatatggcagaggtagacaaatatctcagctattcaatgaaatactatcttcttctcactgtgccagcagctgtagggatgagcgtactctctaagccattgctttacataataacaaccccagagattgctcttggaggttatatggtaactccatttgtctgtctaggtgcaatattcatgggaatgtatggaataaccaataatatacttatactagagaaaaacacaatgatccttggtaaattatggataattgtagccatatccaacattgttttaaatctgattcttgtgccttatc

SEQ ID NO: 958 - DNA, 1024 bp, Methanobrevibacter ruminantium
atgaatattttacatgtggctcatttcttctatccatgtctgtctgctggaggagtagttaatgcaagttatcaaattgctttaaatcaagtaaaagataataatgtgcatgtttacacatcagactcctgtaagcagcgattgaaatttgaagatggtcgttatgatgtagatgtggatggaattaaagttgattactttagaaatctgtcaaacagatttaaattagctaccatgttagacactccactttccgcttattttagaattagaaaggatataaaaaatcatgacatcattcatattcacgaacataggcagaccttagctattttagtaagccattatgctcgaaaaaacaatattccatatattgttcaggcccatggatctgtacttcctttcttccaaaaggaaggattaaaaaacatttttgataaggcatttggatttaagatacttcataatgcatcttgtgtatttgcccttactgaagtggaaaaggagcaatacattaaaatgggagtctctgaagacaagattgaaatagtccctttgggaataaatattgaagagtatgagaatttgccagaacctggaaagttccgttcaaggttcaatattgctgatggggataagctgattctgtttgttggaagaatccatgaaatcaaaggccttgatctattgattgatgcctttaatcttttaattaaggatagttcttcccctataaagttagctattgtagggccagatgatggctatttggacactttgaatgaaaggatagcagagaataatctggaatctcaagtaattattacaggacctttgtataaaagagaaaagcatgaagctttagtggactgtgacttgtttgtaatgccttcaaaatatgaatcctttacaacaagtgggcttgaggcaatggcttgtggcaagccattggttttaaccaaaaacaatcatattcatgattgggttgatggaaatgtaggcatttcctgtgatgatgatgaaa

SEQ ID NO: 959 - DNA, 1024 bp, Methanobrevibacter ruminantium
gtggctaagaaagttttgattattgtaacaggcagaggattaggcggagatgccggaattgcattgaatgtttacaatgcccttaccaaacgaggaatggagtgtgagatagcattggatgaatccgcaccaggtatattgtttaaaaagaacaatatggaatggaataaggttatcattccacaggctggaggccattctgccactcttaagacaactgtaaacgctgcaacacgttctgttaaggctctatttaaaacaagaagcctaatcaaggaaaagaaattcgatctggtccttggaatccttggagggggagccatcataggtgctcttgctgcaaagataacccgaaccccttctgtaagccttttaatcactcctttggacactaagatatgcggaaagattggaactccaataattcttcctgaaaacaatctgtttttagagcctaatattccagataggatggtaaagtccttcttgcctgtaaatgacaacattagtcttggggataagaaaaaggcccttgataagttaaatgaacattgcagtgaacttaagaagaaaaacccagatgcaatggagtttgacccgtctaagcaaacaattgtattctcatcaggttccagcctatttgaaaagactgcccaggcaattgaccagttttcaaaatacagtgacagattcaacttggtcttatgtggagatcctctagaagaggagttttataagtatattgatgaaactaagataatcaatgtaggctttatagactgggtaaatgatcttcttcatcttgcagaccttgcagtattgacaaatgacggccttatgctccatgaggccatggtgtgcaatctgccggtggtcattcttaaaagggtgaaatacggacgctatcatgatatggtttcaatattcaagggagctaccattgaatgtgacttggaagaccttgatgaggccatatttgatgtggtggacaactatgatgactatgctaaaaatacagctacct

SEQ ID NO: 960 - DNA, 1024 bp, Methanobrevibacter ruminantium
atgagcgaagagtcaagcagttccaaagttgcaaaaggcagcgcaattatcctaataggaaacgttatcttccgtgtaggaggatatatctaccgctttttaatggcttcccttttaggacctgccgcatatggaattctcggacttacaactcctttccaagggatctttcaggttctctctgctgcagggcttccacctgcaattgcaaagtatgtatctgaatacaatgcccttgatgagaaggaccttgctcgccaaactatttttacgtcccttaagattatggtattcctagggcttttcttcggattcataatggtattcgtagccgccccaataattacaaactactatcacaagcctgaggctcttcttccattgcaggctgtaggtctcatcactcctttcagcgttatcgttggaggattccgtggagccttccagggagtatataaaatggaatacatcctctatacaagagctatcgaacagatattcatgattctaatggctacagcacttgttcttcttggattatccacccttggtgcagtattaggttccgttttaggttttgtagcatctgcaatctctgcagtctacatcttcaaaagatatatgggcaaatacatacctccggcaaacccagactttaagtttccattgaaggacgagctgaagctggctaagacactgattttcttctcaattcctgtaaccgttgcagcccttgctgaaatgggtatctacagtatctgcacacttcttatgggagccttcctccctgcagctgcaatcggatactttacagcagcagaccctatcgcaaggcttcctttagtcgtatcaaattcccttgctacaacaatactgcctgcaacatctgaagcatatgccttaaaggaccaagtgctccttgaaaaatatgtgacagcaccatataagtatggaatgttctttgttattccaatgtgtgtaggaatagctatcttcgcaagaggaataatgggacttgtatact

SEQ ID NO: 961 - DNA, 1024 bp, Methanobrevibacter ruminantium
gtggttataccagccttcaatgaagaagcgactgtagctcaagtggtaactgtagctcgcaagctatcatatataagcgaagtcatagtggtggatgatggatcaactgataaaactgtagaggaagcggaaagggcaggagcaactgtcataagccataaaggcaaccaaggtaagggggtagctatcaaaacaggatttaaaaattcccatggtgatatagttgcctttatagatgcagatgtatccaatttcactcctacaaagatagacaagataatcaagcctattttggaaggtaagacagacattacaaagaccaaatttgcacgggaaagtggccgtgttacagagcttactgcaaaacctcttttaagtttcttcttccctgaattgaattatgaacagcctttaagcggtcaatttgcaggaaagcgttctgcacttaataaaatcaaatttgaaaaggactatggtgtggatgttggcatagtattggatgctgatgttcatggaataagcattttggaagttgatattggagacattcaacatgacatgtcttcccttgccgatttaaacaaaatggcaaacgaagtggttagaaccatcattgacagggcagttgattatggccgtgtcactatgatggatacccttggaaattatatcagaatggccatcatgggattgtcccttatcattcttggactgttcatgattttctttgttccattcattccattggtcatatccgttttagtggctcttgttggaattgcactgactatagcctatataattaaaatagttcaaaggtcaattcctattttaaggaaaggggatacaagtacggcattaaagtcatttgttaagatgcactttcctgtaatcgtatcaggccttatattgattctaatgctttccacattcttatcagcagcaacatttaatgatggcaggatatcagtggagcttacttcaagaaactttgtatattccccttcagatgactatcatcaaa

SEQ ID NO: 962 - DNA, 1024 bp, Methanobrevibacter ruminantium
atgaaaaccagaattagtgtcatcattccaatttacaatgttcatgaattcctagaggattgcatagaatctgtcttggcacagactatcaatcattgggaccttgtagatgattatcaaaggaatcttcaaatcattttagtggatgacggctctaccgacgacagcggtgaaattgctaagtcttatgcagccaaatatgaaaatgttgaatacagatatgaggaaaatcaaggattaggccatgcaagaaactacggatgcgaatttgctgaaggggactatatcatttttatagattcagatgacatcattcctccaaaggcatatgaaaggatgtatcgcattgcgcttaaaaatgacagcgaccttactatcggatctgtatggcgatttaattcaaagctgacttgggcttccaacattcatgaaatcgcttttggcggaacaaaagagcttactcacattaaggaaagccctgagctattttatgacaccactgcatggaacaagcttatcaaatttagcttttggaaagagcatggtttccaattccctgaaggaatactctatgaagacattccagttacaatgcctatgcattatttggcaaacaatgtttcaatagtctatgaaaactgctatttatggagagtgagggatggaatatccaaatcaataactcaaactacagatgacctgaaaaatgttgaggacaggctttatgtcatgggattggtggataagttctttaacgaaaatgtcaaggaagaggaattgcatagggtaaagaatttgaaatggataaagaacgatttgatgatcttcatcaataagctaaaaagcatggacatagacgagtctcaagaaatcattgaccttttgcttgattatatcgaccgtaacatagaccctaaatactttgatgagataaatgagattgaaaagctcaagtatgaatatttgtttgaaagggattttgacagactattgaaattgcttaattatgagcatgttaatttct

SEQ ID NO: 963 - DNA, 1024 bp, Methanobrevibacter ruminantium
gtgatcattcccatttataatgtttacgaattcttagaggagtgccttgaatccgtcgttaatcagaccataaatgatatggaactgactgacggatatgaaaggaatcttcaaataatactgatagatgacggatctacagattccagccctataatcgcaaaagaatatgcccaaaactacgaaaacattgaataccaccatgaagtcaatcaaggattaggccatgccagaaactacggatgcgaatttgcagaaggggactacataattttccttgattcagatgataagctttctccaaatgcctatgaatggatgtataaaacagccataagaaacgatagcgatatgaccattggaggattctggagatttaattcaaaaaaatacaagatttcaaacattaataaaatagctttcaatggaaacaaagagaaaacacacatcagcgaaagcccagaactcttttatgatacaaccgcttggaacaagctaatcaagcacagcttctggaagaaacataatttccagtttcccgaaggaatactctatgaggacatacctgtaacaatacctatgcattttctagcaaacaacgtttcaatagtctacgaaaactgctacttatggagaataagggaaggaaaatccaaatcgattacacaaacaaccaccgaaattaaaaatctcgaagacaggctttatgtcatggggctggtggacaagtttttcgatgagaatgttgatgatgaaaggctccgccatgtaaaaacaatgaaatggcttaaaaccgaccttcttatttttattagaaagctaagaagcatggataaggaacagggatataaaataatgtcactaatccgagattacatccaaaataacatagatgctgatgaattcaagtacttgaatgagtatgaaaggttaaaatatgaatatctgatggatgatgaaattgacaagatagtttcaatattgaacttcaaggctgaaaatataaaggagacaaaggtctatc

SEQ ID NO: 964 - DNA, 1024 bp, Methanobrevibacter ruminantium
atgcaagatcctaagatttctgtaattattccaatatataatacagaagactatatcgaagagacattactgtctgtaattaatcaaacaatctttgatgagatagaggtcatcatagttgacgatgagtcaacagacaattcaaaatacatcatagagaaatatgcattggactacagcaatattcaagttttccatcaaaagaatgaagggcagggaatatcacggaattatggcctatcaaaatccaaaggagaatatatccactttttagactctgatgattatctgccaccaacagcatatgaaacactatataatatggccttaaagaatgaaagcgatattgtcataggaaatgtcttaagatttgcattatacaacgtatgggaagagagcctttataaaaatgcatataatgactttgatgaagacattgccatcatgagcttaaacgaaaggccttccatattatgggatacccttgtaacaaataagttattcaatagggaattcctgattaggaagaatataagattcccaaacaaaaaaatatcattccaagacattccattttcactggaaagttatatcttagctgattcaatctcattttcaaaggaaatcttccactattggagattgagatccaatcaaagctccgtcacacagcaggacaagagcctaaagaacattaaggaccgccttgaaatcttaagaattgtgcaaaatctcttggaaaagtacgaagttgaagaggagataaggaattatgagtattcaaaatggctgaatcatgacttgaaattctttttgaaaaggttcaactattatcctaaggaatatcatgaagaattgtttgaagaggtctatgggatagttaaaataataccagatgcgctgatagacagcttgaattcatataagaaggttcttttcaccatgataagaaataaggattatgagaatttcctcctgtttgcacctttggaaaatgagctatacaagaatcctgaaattccat

SEQ ID NO: 965 - DNA, 717 bp, Methanobrevibacter ruminantium
atgatcggtgtaatattagcagcaggaatgggcacaagacttatgccccttactaaagacatcccaaaggcattgcttaaaatcaatgaaactaccttgcttgaacgtatgattaaaaactgcataaatgcagacataagcaagtttatagtggtcgttggctataacaaggataaggtaatcgacttatgccccgaaatagctgaaaaatatgatatagaaatcaagaccattgaaaacgaaaaatacgatgttacaaatacctctgtatcaacctatcttgcaagcaaattcattgaagaaaacgaccttgacgactttattctagtaaacggagacaatgtagtagaccctgaaatcattacaaggctcgcagtttcacaaaatacaggcatgataatagataacttcaaggagcttaacgaggaatcattcaagcttatcattgatgatgaatcctttaatgaagacaagacaatagctaacggcaaaataaactccataggaaaaggattagacattccatcctctacaggagagttcattggagtttctaaagtcgtatcagatgacgtagcccaattcaataggattttagaaaaattaattgaagaggaccctcaaaactattatgactttgcttataaggacttaagtcttatcaagaccattgactttgtattgacaaacggattaaaaatggaccgaaatagatga

SEQ ID NO: 966 - DNA, 1024 bp, Methanobrevibacter ruminantium
atggcagaagagaaaagaagctttaaaaaactaatcaaagacatattatacatctcagcaaagcgcagcgctagagcactatattatattggctcatacattatccctgcaaatgaaaaaataattctatttgaatcaagcaatgggcgaaactacacaggaaatccaaaatatatctatgaagaaatcgtcagccaaggccttgacaaggagtacaaatgcgtctggtccttcatgcatccggataagaaaatcccaggaaatgccatacaggctaaaagatccttttttaaattcctatattacacattgcgtagcggaacatggatatttgactccagacatttatattacttaaagaagaacaagaaaaccaaatacatccaaacatggcatggaactccccttaaaaagcttgcattagacatggattacattgacatgagtggaaatcaggatattgaagcataccacgaggagtttagaaaaaacacatccgcttggcaatatctcatatcacaaaacgaatactcatcaaatatattcagaagggcttttgactttaaaggagagatgcttgagataggatatcctagaaatgacattcttgtaaacaaagacaacgaaaaagacattgatgagataaaaaccaggcttaatattccaaaggacaagaaaatcattctatatgctccaacttggagagacaatcagttctataccaaaggccaatataagtttgcaacagaaatggacttcgataggctatatgaagaattttccgatgattatgccttaattataaaattccattatttggtcaaggagaatatggattggtccaagtacaatgatttcattatagaatgcgatgcagattgggacattcaagagctttatctaatttcagacatgatgataactgattattcctctgtaatgtttgattattccatattaaaaagacctatgatcttctttgcatatgatctagatgattataaaaacaatcttagggactttt

SEQ ID NO: 967 - DNA, 1024 bp, Methanobrevibacter ruminantium
atgtctattaataagtcaaaatctaatttaagcctaaaaaataaacttaaatctttatttagtggcaattccaataaaagcagatatcaatccaaactaataaggggggacttcgattcactccatgacttgaatatagcatatgtcttgaagggctttcctacactttcacagacttttgtttcaaatgagcttagatatttggttgaagatggcttcaatgtagttgtattctgctatatggatcctgcagacttggttgaattggattttgatttggaagtaattcgctttgatgagtcagatgaccctactgggaaattggagcaattactattggactatgagatagacatagtgcatacccattttgtctatcctccctgtacagaatatacatttcccgtttgcgataggctgggaattccttttacagtatttgcacatgctgttgacatcttcaaatatgatgtcgataaaattaatagggttgatgagatatccaaaagcccattctgcaagggaattcttacattgagcaactatcacaagaatcatttgattgaaaggggagtggataaggataagattcatattacaaggcaggctactgactatgagatagaggagcttgaattgaaagagaggaatgtgagaaatattgtaagcatttcccgttttgttgaaaagaaaggaattgatgtcttgattgatgtggcagacattctaagggatgaggattatgagttttccatctatggatttggaggacttgaaaaggcatatcaaaggcagattgatgagttgaatctagataatatttccattaaggggcgtttggacggtcctcaagaggtaaaagaggtctttgataaggcagatatattggcgtctccatgcagaatagctgaaaatggcgatagggatggaattcctacggtcatatttgaggcaatggcctatggagtgtgtgtattgactacagaggtttcagcaatccctgaagttattgatgatggaagga

SEQ ID NO: 968 - DNA, 996 bp, Methanobrevibacter ruminantium
atgaccaaaccaaaagtttccatgattttatcagcatataatgaagagagattcatcgataaggccatatgcagtctaacaaaccaaagccttaaagacatagaaataatcataataaacgatggatccaccgataaaacaccagaaatcatagagaaatatgctgaagaagacccaagaatcactgtaataaaccaatcaaatattgggcttggagcaagcagaaataaaggaatggcaattgcccaaggagaatatgtgggatttcttgatggagatgactggtacagattagatgctcttgagatagcatacaatgaggcgaaatcaaaggatacagacataaccatgtatcagatgataaattatgatgatgcaacaggacgaatatacgaaaacgactggtttaatctaaacaaccttgatgaaagctttgatggtatagtatttacacctgagaaaacaaaagactttctatttgacttatcagtaagttcatgccaaaagatctatagaaatgattttttaaagtcaataaatgcaagctttccagaaggaatctattttgaagacatgcctttcttcttttatgtctatcttaaggcagagagaatttcaataatcagacatcatttttattacagacgaaagcacaatgcttcaatcacccatgtggtagatgcaaattatctggatactgtggaagcgggatgcgaactaatgagaagattcatagacaatgggttctatgatgactataagttcgaccttatcgcatacaagataaatggtccaagaatggctcttatggacataactgaagatgctaaggaaccgttgttcaatctaataaaagaagactatgagaagataaaaaatacagaatattatcaggattatcttgataatctaggtccaaagaagaaaaagttctttttagatgtaattaagtatgacaattatgaggaatttaaaaagaacaatccagaatattag

SEQ ID NO: 969 - DNA, 1024 bp, Methanobrevibacter ruminantium
atgaaaatttgtattgtaggacaaggatatatcggattgccaactgcagcattatttgctaaaagtggctgtgaggttgttggcgtagacataaataaggaaatcattgaaaagctaaaccaaggaatagcccatatagaagagcctggaataagcgactcaatcaaaaatgcggtagaccaaggccattatcatgcttcattaactcctgaggaggcagacacattcataataaccgttccaaccccatatttgcctgaggatcttagctgtgacttaagctatgtaatatccgcttgcaattccattctccctgtccttaaaaagggaaatgtcgttatcatcgaatcaacaatagctccaatgtctacagatgaggtaatcaagcctatctttgaaaatgaaggctatgtcattggagaggacctatatcttgctcactgccctgaaagagtattgcctggacaaataatggaagagcttgtaaacaacaacagaatagtaggtggaatcactgaagaatgtactaaaaaagctgcagatgtctatagaacctttgtaaaaggagaaataatagagactgaagcaaagactgcagaattatcaaaatgcatggaaaacaccttcagagacgtcaacatcgcacttgcgaatgagcttgctaaaatatgtgcagagattggcgtaaacgcccttgacgttattgaaatggcaaacaagcatccaagagttaatatccatagcccaggccctggtgttggaggccactgccttgcaatcgatccatatttcatctatgcaaaggctccagagacagcaaaaataatcaagcttgcaagggatacaaataacagcatgccaggttttgtaatagagaataccggaaagattctaagcaaattagacaaagatgcagagaagataagcgtatttggagtggcctataaaggaaatacagacgatgcaagggaaagccctgcatttgagataattgcaggactgaaggctgcaggatatgaagtgg

SEQ ID NO: 970 - DNA, 861 bp, Methanobrevibacter ruminantium
atgaggattttaattacaggcgcttatggaatgttaggatctgacttaagagaggttctaaaaaatcatgatttaattgcaacaggctctaaagacctagacatcacagatgaagaaagatgtattgattttattgctaaagaacgtccggaaatagtcataaatgctgcagcttacactgctgtagatgactgtgagactcattatgatgatgcatatgcagtaaatgccctagggcctcgtaatttggcaatagcctgtaataagattgatattcctttggtccatataagcacagactatgtctttgatggaactaagcgaactcctcttatagaaaatgacaaattaggtcctcaaagcgcatatggaaagaccaagcttgctggagaggagttcattcaggaaaacactcaaaaatacttcattcttcgtaccgcttggctatatggaatccatggaggaaactttgtaaagaccatgttggatttggctaaggaacatgatgagataactgttgtaaatgatcagatagggtctcctacattctctcttgatttggcaatggcaatatgtgaggttctagacagcgataagtatggcatctatcaccttacaaatgatggggaatgttcctggtatgattttgcaaaagaaatctttagaatatctgatattgatgtgaaggtcatacctgtaagcactgaagagtttccaagacctgctccaaggccacattattctgtattaagcaatgtaaaatggaaaagcgcaggttttgttccaatgagagattataaggaagctttgaatcaatatatttctttatataatttttttgtaaaaataggtaaaatttaa

SEQ ID NO: 971 - DNA, 873 bp, Methanobrevibacter ruminantium
atgaaaggaatcgttttagctggtggttctggaaccagattatatccaattacaaaggctgtttctaagcagttattgcctttatatgataagccaatgatttattatcctatatctgtcttgatgctagcgaatattaaagatatattaataatatcaactcctcgtgatttgccaatgtataaggacttgctaggggatggaagcaatttaggaatgtccttttcctatgctgagcaagagaatcctaacgggcttgctgaagcattcatcataggggaagactttattggcgatgacaatgttgctcttatattgggagacaatattttccatggacacagatttactgaaatcctagaaagagctcgtgatcttgatgatggagcggtcatattcggctactttacaaacaagccagaggcttttggggttgttgagtttgataatgaatggaatgttctctccatagaagaaaagccagaacatcctaaatccaattatgttgttccgggactttatttctatgataatgatgttattgagatagcaaagagtgtaaagccttcagataggggagagcttgaaataacctctgtaaatgaggagtatcttaataggggcaagcttaaggtagagctcctaggtagaggtatggcttggcttgatacaggtactcatgatgggcttcttgaggcagctaatttcattgagacagttcaaaagagacaaagtttgtatattgcttgtttggaggaaattgcttattccaagggatatattagcaaagaagagcttttaaaattagcagagcctcttaagaaaactgcttatggtgattatttaactaaattagcagaaagaaagatttaa

SEQ ID NO: 972 - DNA, 579 bp, Methanobrevibacter ruminantium
atgggcaagtttaatataattaaaagtgaaattgaaggtgtatttacagttgaacctaccgtttttgaagatgaacggggctactttatggaaacttataatgagaatgactttaaggcagaggggattgatttaacctttgttcaagacaatcaatcaaagtcatcaaaaggagtacttagaggcctccatttccaatacacacagccacaaggaaagctggttcgtgtaataaagggagaagtcttcgatgtgggagtggatcttagaaaagactcacctacatatggaaaatggatgggggaaatactctctgaagaaaacaaaaaacagttatttataccaaaaggatttgcccatggctttttagtattatcagatgaagcagaattcgtttacaagtgtacagacttctataaaggagatgatgagggaggaatccaatggaacgaccctgatataggaatcgaatggccattgggagaccttaaggaagaggatctgattctatctgaaaaggacaagctattgaagccaatgaaagacactccaactgatttctatatggaagatgaatga

SEQ ID NO: 973 - DNA, 1008 bp, Methanobrevibacter ruminantium
atgacaaaaattttagttactggcggtgcaggttttataggtagtaactttataaaatatatgcttgataagtatcctgattatgaaatagttaatttagatgctttgacttactgcggaaaccttgaaaatcttgaagatattgaagataatccgaattattcctttgttaagggaaatatcatggatgaaggtcttgttgatgttgttgtaagcagcgtagactacatagtcaattttgcagctgaaagccatgtggaccgcagcatagaagacccgcagatattcatcaaatccaacataatcggaacacaggtattgcttgatgcagcctataaataccaaatcaaaaaattcctacaagtatccaccgacgaagtatatggaagcctaggcccagagggatacttcaccgaaacaactcctctccaggcaaacagcccatattcagcctcaaaggcaggtgctgaccttatggtaagagcatatggagagacattcgacctcccaatcaacataacaagatgctcaaacaactatgggccttatcagttcccagaaaaactgataccactaatgatctccaatgccttagaagacaaggagctcccaatatacggcgacggaaaaaacataagagactggctacacgtctacgaccactgctcagctattgaccttgttctccacaaaggaaagataggagaagtatacaacattggcggccacaacgaaaagcaaaatatagaaatagtaaaacttattcttaaggaacttgataaaccagaaagcctaataaaatttgtaaaagacagattaggtcatgacagacgctatgcaatagattcaaccaaaataacagaagaattaggctggaaaccaaaatacacatttgaaacaggaatagtggaaacaatccattggtatttggacaatcaagactggatggaaaaggtaaaatccggcgaatatcaagaatattatgaaaagatgtactctaaaaagtag

SEQ ID NO: 974 - DNA, 984 bp, Methanobrevibacter ruminantium
atgaaagtatcagtagtaacacctaactataatggtcttaaattcttaaacgcctattttgaaaccttagcttttcaaagtaggttcatagaagagatcatcataatcgataatgcatctactgatgccagctgtgatcttatagaagaatacataaacagtcctagctataagattgacataaaacttataaaaaatgataaaaatcttggatttgctcctgcagtcaatcagggcattcgcttggctaaatccgaactaatctattctgtaaacaatgatgtagaacttgaatttaatactatagaaacattaattcaatctatggaaagatccattgaagaggggaaaaatccattctccattcagtcaaagatgatacagtaccataatagaagcctaattgatgatgcaggtgatgaatataatctacttgcatacactaagaaactaggcgatgggagtccgattgacaactacaatgaaaaaagggagatattctcatcctgtgcaggtgctgcattgtatagaaaatccattttggagaaaataggtctttttgacgataatttctttgcttatgtagaggatatagatctttcattcagggctcaaataaatggttatagaaactacctagagcctaaatcaatcatctatcattatggaagtgctacaagcggaagcaggtataatgagtttaagataaggcttgctgcacgaaataatgtttggatgatttataagaatttcccaattcctctaaagattgttaatttcatcttcatatttcttggatttttcataaaatacctcttctttttaaggaaaggattcggttcaatctatttgggcggagtaaaagagggcttaagagaaagaaaaggaatagaaaagacccactttgaatggaaaaactggaaaaattactttaagatagaatggaagatgattaagaacacatttggctactttaaaaaatag

SEQ ID NO: 975 - DNA, 897 bp, Methanobrevibacter ruminantium
atgagaaatatagacttatcaattattgttgttaattataacacctttaaattaacaagggacactatagattcttgtttagctgaacctactcattatacatatgaaatattccttgtagacaacaaatcaacagatgacagccttgaaaaacttcaagaatactttaaaagtgaaacagaacgaggaatattaaaaatcattccaaaccaatccaacgatggttttgcaaaggcaaataatattgcaatagagcaagcaaaaggggatttcatacttcttttaaactcagacacccttatgaagcaatccactatcgacaagtgcatggattacataacagacaaaggccacgatgatatagatgcattaggctgtaaggtttcccttgccgatggaagtcttgacaaggcctgcaagcgcagctttccaaatcctgcaaactccttttataaattgtttcatataaatgtagatagtgacaagaacgattataatctggatgatcttgatgatgatggtatttatgagattgattgccttgtaggggcatttatgcttgttagaaggactacaatcgatgaagtaggccttttggatgatgctttcttcatgtatggagaggatattgattggtgctatagaatcaaacaggcaggatggaagatagtttacttcggccaggcagagataattcactataagggagcaagcagcgaggataaaaatactaaaaaaagaaatccaaagattatttatgagttttatagggcaatgtatgtcttttataaaaagcactatactaaaaaatataatttccttgtaaacattgcagtctatattggaattggagttttgctagtttttaacttagttagaaatgccttcaggtcttga

SEQ ID NO: 976 - DNA, 1024 bp, Methanobrevibacter ruminantium
atgattaaagaaaatcagagaatattaaatgcaatactagtcatcatagacattattgtaattcttatctcactaggccttgcatactttgtaagattcaagaccaccatattctcagtaggaggctcccttccattcagtgactatttcatattcacaatcgtttgcataattcctacttatattctattatactacttctttggtctttataagccattccgtaaccaatcatcaatattctctggtgctgaggacattgtaaagtctgacataatggcattcatcatcctggttgctattttgttcatcatcaatcagcctaacttttcaaggatcatgctccttcttttaagcctatttggaatgattctcacaatcgctgaaagggtattggtcgttcttgtattgagaatgatgagaacaaacaaccttaacctgaagcatatgcttatcatcggagacaatgacttggcattcgagtttgcacataagatcaactctaaaacctatttgggatacaatattgccggatttttaggaagaaaggaaaatataggcaaacgatttgaaggaaccaagtttataggcagctttgatgacttgcctcgtgttctaaagacccataagtttgacagggtggtcatagccattccccttaagtattattaccatctaaacgaaatcgtggatgcatgtgaggaagagggaatcaaggcagaaatcattccagactattataagtatcttccggctaagccttcagttgacatgcttgatgacatgcctatcatcaatatccgctatgttccattggatgatgccttcaataagttcaagaagatagtctcagattactttgtatccattgtagctattataatcacatctccaatcatgattttaactgcaattgcaattaagattgagtctccaggacctatcatcttcaagcaggaaaggataggctataacggtaagcccttcatgatgtataagttcagaagcatgaaggttcaggatg

SEQ ID NO: 977 - DNA, 1024 bp, Methanobrevibacter ruminantium
ttgggaggatttatcttggttgaaatatcaattgtaattccagtctataatgttgaaaagtacttaagggaatgcttggatagcgctgtcaatcaaacattcaaggatattgaaataatatgcataaatgatggctctacagacagttccttagatattttaaaggaatatcaagagtctgatgatagaattatcatattcaatcaggaaaatcaaggtcctggcgctgcccgtaatcttggaattaataaatctaaaggcaaatacgtatatttcttggattctgacgattatttggaactgaatgcattggaaaagctttacaatatctgtgaggaaaagtcattggactttgtacttttcaagctgcttaacttcaatgacaaaactggaaaaaccttccaaacaaagtattataatatggctttcctaaatgataggataggagataatgtattttcatataaggatttatatgattgcgtttttaatttggcagtgtctccaccagctaagctatataagagagagcttattacagatatcgattatccggaaggcatcatctttgaggataatgtattctttttaaagacccttctaaaggcaaaaagaatctatttccttgatgagtttctatacaatcgccgcaggagggatgactcccttacaagctcaggatctgatgattattatgatataattccttcaatgaattatctatttgacatttgtcgagacctagatgatttcgaactcctgaaggaaggattgtattataaaaagttcaaggagctttatataagattctccaaggtcaatgatgtccataaagaggagtttttcaatctaatcagagaggattgcctaaagcataaggaagaaatcgatgaggatatagcaaatgataagctaaggaagagatctaagttcatatatgaatctgtgctttcttcagatgactataaggagtttcattatagaatcagactttatgataagaataaagagataaatgacttga

SEQ ID NO: 978 - DNA, 1024 bp, Methanobrevibacter ruminantium; identical to SEQ ID NO: 859

SEQ ID NO: 979 - DNA, 1011 bp, Methanobrevibacter ruminantium
atgcatgaatatgaaattagtattataataccaacatataattcttcaaaaacaattgaaagaacaattcattcaattttaacacaggattttaaaaattatgagatggtttttgtagatgatgcatcaaatgatgatacagtaagttgtatacaagaaactttagcagataaaaaggtaaattatcagcttattgtaaataaaaacaataaaggtcctgcctattgcagaaataggggagtatttgcttctagaggaaagtatattgtctttgttgatagcgatgatctaattcaatttaaccatatttcctcattgcataattatgttaaatcagacaattttgattccgcctttacaaaaggaataaaaataaataatcaggatgagcttatagattttaaagtggataaatatgatggcttgattcatttggctcgtaaaaataagggaattgttagagccaaagatttgataaatcttgaattgcttatgaaaattccattttcctttgtattgttgatttatgataaggaaatcatcttaaataattccctagaattcaatgaagattatagatatggtgaggacactgattttgcacttaggtacttggcaaattgtggcaatgttcgtgtaattgataaatatacttatttttattatcaagaggaagattctatttcaagacaggtctctttggataggtttgaatctgtaaaactttttgaaagtctggattcctattttaaagaagatgatttgagagaaaagttggttcattcaagaatccctagatttatttttggcaatatgaattacttcttctacaatggatacaatagtgaagatgtttttaaaaagatggatgttcttgatttatttaacaagttaaggcagtttaaggtgtttgaaaaaagagattggaagttttatcttaaggttagattgtttttattgaatcatagattgtattataaattgtggttaaggtttaaaaataatctataa

SEQ ID NO: 980 - DNA, 213 bp, Methanobrevibacter ruminantium
gtgaatgatttaaaaaagttatatgttttgcttgcaattttaattgttatttatgtaggtattaacttttcatataatggtttagacaccattaatactttaactcatgttaatttagatttaggtccaagcatggacaatgctaacgatgcaaatcatattaaaatcggcagtagttcatttaccaaattaagcaaaatttttacctggtaa

SEQ ID NO: 981 - DNA, 1008 bp, Methanobrevibacter ruminantium
atgacaaaaattttagttactggcggtgcaggttttataggtagtaactttataaaatatatgcttgataagtatcctgattatgaaatagttaatttagatgctttgacttactgtggaaaccttgaaaatcttgaagatattgaagataatccgaattattcctttgttaagggaaatatcatggatgaaggtcttgttgatgttgttgtaagcagcgtagactacatagtcaattttgcagctgaaagccatgtggaccgcagcatagaagatccgcagatattcatcaaatccaatataatcggaacacaggtattgcttgatgcagcctataaataccaaatcaaaaaattcctacaagtatccaccgacgaggtatatggaagcctaggccctgaaggatatttcaccgaaacaactcctctccaggctaacagtccatattcagcttcaaaggcaggtgcagacctcatggtaagagcatatggagaaacattcgaccttccaatcaacataacaagatgctcaaacaactatggcccataccaattcccagaaaaactcatccctctaatgatttctaacgcattggaagacaaggagcttcctatatacggtgacggaaaaaacataagggactggctacatgtctacgaccactgctcagcaatcgacctagtcctccacaaaggaaagataggagaagtatacaatataggtggccacaacgaaaagcaaaacatagaaatagtaaaactcattctcaaggaacttaacaaaccagaaagcctaataaaatttgtaaaagacagactaggacatgacagacgttatgcaatagactcaagcaagataacagaagaattaggctggaaaccaaaatacacatttgaaacaggaatagtggaaacaatccactggtatctagacaatcaagactggatggaaaaggtaaaatccggcgaatatcaagaatattatgaaaagatgtactctaaaaaataa

SEQ ID NO: 982 - DNA, 564 bp, Methanobrevibacter ruminantium
atgggcaagtttaagattgttaaaagtgaaattgaaggtgtatttacagttgaacctaccgtttttgaagatgaaaggggctactttatggaaacctacaatgagaatgactttaaggcagaggggattgatttaacctttgttcaagacaatcaatcaaagtcatctaaaggtgtccttagaggtctccatttccaatacacacagccacaaggaaagctggttcgtgtaataaaaggagaagtcttcgatgtgggagtggatcttagaaaagactcacccacatatggaaaatgggtaggggaaatactctctgaagaaaacaaaaaacaactatttataccaaaaggatttgcccatggctttttagtattatcagatgaagcagaatttgtatacaaatgcacagacttctacaaaggagatgatgagggaggaatccaatggaacgatccagaaataggaataaaatggccattgggaaatcttaaggaagaagatataattttatctgaaaaggacaaattatggaagccgatgaaagagactccaactgatttttga

SEQ ID NO: 983 - DNA, 873 bp, Methanobrevibacter ruminantium
atgaaaggaatagtattagctggaggttctggaacaagactgtatccaattacaaaagctgtatcaaaacagttattgcctttgtatgataagccaatgatttattatccaatttctgttttaatgcttgccggaattaaagaaatattaataatttctactccaagggatttgcctatgtataaagaacttttaggtgatggagagaatttaggaataagcttttcatatgaagctcaagaaaatcccaatggtttagctgaagcttttataataggcgaaaaatttattggtgatgataatgttgctcttattttaggagataatgtatttcacggacatagatttagtgaaatactgaaaagagctatgaaccttgaagaaggtgcagttatttttggttattacactcaaaatccagaaagttttggcgtagttgaatttgatgatgaatggaatgttttatccgttgaagaaaaacctaaaaatccaaaatcaaattatattatcccaggactatatttttatgataatgacgtgattgaaatagctaaaaatgttaagccctcatttagaggtgaaaaagaaattacctctgttaatgacgagtatcttaaaagaggaaaacttaaagtagaacttcttggtagaggcatggcttggttagataccggaactcatgacggcttgcttgaagccgcaaattttatagaaactatccaaaaaagacaaagcgtttatgtagcatgtctcgaagagatagcatttataaatggttatattcctaaagagaaacttctcgaattagccgaacctttaaaaaaaactaattacgggcaatatctaatcaaactggcaaaaatgaaaaaataa

SEQ ID NO: 984 - DNA, 1024 bp, Methanobrevibacter ruminantium
atgaacagattttggaatgatttaattttacctttattttatgaatttaaaccagaagtaattgttgaaatcggttgttttaaaggagaaaatacaaaaaacattttagaatattgctattatactaattcaaagttaaaagttatcgatccaaatcctgattcttcttttgaccccatatctttaaaaaataaatatggagataaattcgaatttttaaaggaattaagtttaaatgggcttaatttaatagaggattatgacgctgtccttattgatggagatcataactggtatacagtttataatgagcttaaattaattgaaaaaagattcgatcaaaataattttccgctaataatctttcatgatgtttcatggccatatgctagaagagacctttattataatccagaacttattcctgaggaatttcgccatccttataaaaatttggctatgtttccagataaaaatgaattgggagatattggtttaaatccaacttttaataatgcagtttttgagaatactcctaaaaatggagtcttaacagccatagaagattttttagatgaaactaatttaaatttatcattcttctgtttaaatgcattctatggatttggtgttttgtttcctagtcaatcatgtgatgaaaaaacaatattgcaaattttttatgatagtgatgttatagggcttttagagaaaacttatttaaaattaagatttacacaggaacacattattaaaaataagaatattgaaataaataacttaaaagatatgaataactctttaaataaaaaaaatattgatttaactggcattaattctaatttagaaaaagaactagacaaactaaacaacaccaaaacagaaatagaaaaagaactagacaaactaaacaacaccaatatagacttaaaagaaaaactaatcatttcaaccaataaccaaaaggaattagaaaagctattagataatctaaaagatgacaaaacctacctagagaacgaac

SEQ ID NO: 985 - DNA, 1024 bp, Methanobrevibacter ruminantium
atgacatataaagtaagtataattattccagtatataatgcagcagagtttattattagggatactttaaaatctatagaaaatcaaacaatggattttgaggatattgaagttattttagttaatgattgttcaacagataatacagcgaaagtaattaatgaatatgctaaagaacatgagaatattgttccaataaatcttaaagaaaataacggtcaaccaggcattccaagaaacattggaattacctatgcaagcgcagactatcttatgtttttagatcaggacgatacctttaaaaagaatgcatgtgaaacattatacaataaaatatcaacggaaaatgttgatatggtatgtggtaaccacaatatcgtaagcaatggaagatctaacatttgctttaacttcgattgggccgaagaggatgaaattaaaatcaataagattgacgaaaacccaaatttcctaacaatgggagttgcagcatggtctaaaatattaagaagggaatttgtcttggataataatttgaaatttaccgaaggagttggggaagatatattcttctcaatcagggcattgttactggcagaaggaataattctgcttaaaaatttcatcgttgtggattacctagttaggggggaatccctttcacaccaagtcaatgcagaatatcttgatgaattctgtgagttttacttaaatttctttaattactgtgaaaaaaacataaaaaacgacaatttataccatcctttattcaatggcaggctgaaccatgtcctatccatgcttttcttcgctgatttgtactttgatgacctctcttgggtattaatcaagattcatgaattgtttaagaaagtggctgagaaaccattcgtttttgaagatacttcttatagaatcttttttgatacattgataaaagatgaatatcctttcgaaaatagcattaatatatacagcgccattaaaagtaatagggaaagaaaatttgacaaaggagtaaaat

SEQ ID NO: 986 - DNA, 1024 bp, Methanobrevibacter ruminantium
atgagtataaaaaataaattcttatctttatttaattcatcatctaataattctgattttgaaaatttaaataattattataaaaaagttctagaggatattgaaaatgaggatatatctggctatgatcgaaatttaaaatattacaatgacttaaaagactgtgaactttttagttctgaatattatataacaaaccaaggtttagagctttcagaagaatatgctttggcccattatctaaatgaaggttataagcaaagcagaaatccaagccctgaattcaataatgacaaatatctcagattatatcctgatgttcgcctagctagccttaatcctttagcccattatgtgttatatggagaaaaagaaggcagaagattgcctttaagcgaatatgaagaactggaaaatgagatagtttctgtaaaaaatttaatttatcaaaacagagtaaccgataatttagtcttgcttagagataaagtgtccaaaggcaagaaagtcaatgttgttttcgttttacctgcaatgatgtttgtatataaagacttatataactattttgataacgatgatatgtttaatgttcaaatcgttttggttccccacagattaggaaacagtcaaaagattacagatgttgcaaaagataagcattatcaaattttcagctatctcaaagaaaaacaatacaatgtaattgatggatatgacttcgaaaaaaatgaaggcatcgatttagtctcaacttgcaatccagatataatattttatgtcttgccttatatgaggattttccctaaaactatgaaaatcagtaatctcccatccaacatattatatgcatatatcccatatggggaatttgtagaagacaacttagacgatttattctttaatttcggatggaatgaaattgcatggaaaattttctgcagtaccgaagaatatctgattaattctactgaaaaatctattgtcggatcaagtaatgtagtcttagcaggttctgctagga

SEQ ID NO: 987 - DNA, 1024 bp, Methanobrevibacter ruminantium
atgggtgtagtaatgaaaaagaacaattttaataaaaagataactttcgtcgctaattacttttggactagcattaaggaaggttcaaaatccaattcttattttaattatgataattacctaaaaaaatatcctgatgtaaaggaatctggaatgaatccttttaaacactatctattgcatggaattgatgaagagcgcagtactaattttgatgaaaatattaattcatacagtttagttgaaaattccgatttatttgattatgaatattactgtgaaaaaaacaatctgaaatttgattcctatagtaaagcattaatgcattatcttgaaaagggatataagaaaggatacaacccaagtataaaatttaatgcagaagaatattatgaagttcgtcctgatgttaaaagggctgatgtaaaccctttagttcattatttaaagtatggaaaaattgaagtaacctcaatgactgaaaatttaaatcttaaagagtatcagctcgttaaaaattcaaatttatttgattataattattatatggaaaaaaatcatttggatttaagaaacgaaaccgaggcaatttatcattatttggaaataggttataaaaagggatataaccctagcaataagttcaatggtgaaatttattttaagaaaaatccggatattgaggaatctggctggaaccctttagttcattatttgaaatatggtcaaaaagaagagcgtactgataaatgtgataaaaacctgaaagaatattctttagttaaggaatcaggattatttgattatcaattttataaagataaatatgatttagatttaaattcatataagcgcggtttaattcattatttggaatttggttacaaaagaggatataaacctagcagaaattttgatggggaagaatacttaaaaagatatcctgaagttaaaaaagcaggatttaatcctttagttcattatttgaagtatggtgtgaatgaggaaagaataggattaagaa

SEQ ID NO: 988 - DNA, 801 bp, Methanobrevibacter ruminantium
atggaatttataaaatataaatctcaattcgaaaaaatgatagataataaaattattggtatgccagaattaattgattccaatataagctttaaaggtaaaaataatattttatgttgcaacaatattaaattagaaaatatagacatagatttcaatggaaataattctgtaatttttttaggttctaatctaggcgtaaattctcatttaactatttttaataattccacattattccttggaaaaaataatacttgcggatcttcaatttcaatttccgttgctgaaaatcaaaatcttatcattggagataattgtattgttgaaagtgatgtaaaaattagaacttcagataattacccaatttataattatgaaaacagtaggattaaccattcaaatagcgtatttataggggataatgttttattaggtgaatcttcatttatttcaagaggagttaaaataggttccggatcaataattagcccatgtagttttctgccacctctgtttaaagctttttcaaattcatatgtattagggaatcctggaagaatattgaaggaagatgtttactttgtaaatgattcaattaatgattatactattgaagagattaaaaactcttcaatcaatgaaaatgaaagtggactttttgattttgtagaaaaagaaacattatctttagacaagattgataatattctaaaaaaatttaactctgaagactctttagattttattcaaaaattatttttacagaacaagcataaaaaccgtttcttcattgagtaa

SEQ ID NO: 989 - DNA, 1024 bp, Methanobrevibacter ruminantium
atgaaaaagccaaaaacaaaagcgcaaaaagaatctagagagaaaaaacctaataatctaaaaagtgattgtatgaaaaaaattttatatgttttacattctggagttacaggaggtactttcttaacaaataaagatttgatgaaaaatgtggaaaaggaatttgatgtttatttattgagtgctgaaaataagttcttaaaattatttagcttttccaataacaaattaaaattaataagaaaatatcatagaaattatggaatcaatgtagaaacagaagagacagaaacaaataatatctcatggtctgcaaaagatttccataattcctggctaagcaacatttattttgaaatattggttaattataacatagatattgtccatataagacatttgattaaccatagttttgatttgccgcaagttgctgaaaaattaaacatacctattgttttatccctacatgacttttattttttatgtccattttacacattattagatgaaaattataattattgcgcaggtgaatgttctcataataaaaaaaattgctattgtcctatggattcattaagcgatataaattccaaagaatttatatcagaatggagagttaatgttttaaaaatgtttaattatataaatgtctttgtaacaacttccttttttgtaaaagatttatttttatccatatactctaatgaagatatcatcaataacaataactttaaagttattgaacatggcagggatttcccaaaattaaaaaaacagatgtttgaaatcccttcatcaaacaaacctataaaaatcttatgcccagctaatcatttaaacataatgaagggttcgcaattgattaaaagaatcaaagaagaggataataaaaatctgatagaatttcattttttaggaaattgtcatgatggaattgaagaatatggtttttctcacggcacttttgaaagagatgaattccataaaaaagttgaagaaattaaaccttcatttgttg

SEQ ID NO: 990 - DNA, 1024 bp, Methanobrevibacter ruminantium
atgacaaaagtttcagtaattattccaatatataacggtgaaaaatatcttaaggaatgtttggattccgtctgttgccaatcattaaaagatattcaaattatctgtgttaatgatggttcaactgataaaaccctttccattttaaatggttttgcatcaaaagacaaacgcataaaaataataagcactgaaaacagaggacaaggttcagcacgtaatactgcattaaaagaagcccaaggagaatatattagttttgttgatgcagatgattggattagtgaaaatgctttagaacttctatatttccatgcaaaatcaaaagatttggatatgcttttttttcaaatgattaattatatggacaattcaaaaaattatgttgaaactgaattatataatcatctgtgttttgaaagaaatgcaattgatgaagatacaatttttaattttaacgatataaaagaatttttatttaaaataccagtttgtcctgtttctaaattatataaaaaagaatttttagattcaaatgatctttatttcccagaaggcatgttttttgaagacaatgcctttttttacaattctttatttaaatccaactgtcttggatttttaaaaaagcatttatattatagaagacgccatgccgactccgttactcaaacatttgataaaaggaagtttgatattgttaaggcaacaaataaggtattagatgtgtttttagaaaatgaccaatatctaatttttaaaaaggaacttattaatcatacgttctccatgctgttggaatggtttaacaaatcccctctagaacttaaagatgaattttataggttaattaaaagagattttagaggatttaataatttaaaagaagattttaagaacaatttgaaagaggaatacttattaatatttgatatttccgataagaacaaatattatttggatttcttatctgaatataagctatcctcagcagattatgatattttcgataaagaaagatatt

SEQ ID NO: 991 - DNA, 771 bp, Methanobrevibacter ruminantium
atggcactgattgagaaaaacgaactcttcttattggaggaaatcgtaaaaaagaattttgcagcaaaatataaagattcgatattagggatattttggagtattttaaaaccattattaatcatgattttacttacaatcatattttcaaacttatttggcggaagcattgaaaattatccagtttactttttatccggaaaaattatctttgatttttttaattctgctacatcagtatcaatgatgtcacttaaaggcaatataaacattttaaaaagaactgctgcaccaaaacatatttttacgttagcaggagtcgtttcagaatttttaaattttttaattaccttaataatattaattggtgtcatgattgtgaccagatccccattttatatattggaatcaatgatagcaataatcccgataatgtcattaatcattatgattactggaattagcttaatactagctgttttatgtgtttacttttcagacatacaacatttatggggcgttattacattaatgttaatgtatgcatctgcaatattctatccaatgaacataatccctgaaccgtttcacggaataatgattttaaatccaattttttgggttataggccaatttagaattcttgtgctatggggaacaataccaagtaggatgaatatgttgaatttagttcttttatcagtgattattttagtgtttggaataatagttttcaagaaatttgagaaaaagattactttgaaattttaa

SEQ ID NO: 992 - DNA, 225 bp, Methanobrevibacter ruminantium
atgaatcaaaaaagagatgaattaaattctaaacaaaatataaacttggattcagaaaatgaaatttcctcatcagaaattaatcttaagaaaagagatcctcaaaataaatcagatttaatagctcagcaacgcatgaaagctaaaagggaattaattgaaagatataatatgtctgaaagtgaggctgaaagtactctccaaaagcataagaaaataaggtaa

SEQ ID NO: 993 - DNA, 1024 bp, Methanobrevibacter ruminantium
atgcaaaagaaaaataaaaaaataactaatgaaaaagagatagaaattaattcaaataaagttagaatggatgataaaaattgttctttggagaatagcgctggtgtttcagaaaacaaggataaaaatgatgaagctataaaaatacaaagccaaaattctcaaattgaaggagaatctgaggaaattattccagagcatgttttagaaagacaaaatcctaataaaattgataatagtgattatgaaataaattctgtttccgatacactgcctgtaatagaggaaggggaatcaaagcctattcaaaatgccgaggatgaaatcgtaaagaaagagcttgttgattctgtttctgatgtggtgcctgttgtgggagagaaagaagaaaataatgaacctataattaagaaagacgattcatcagatgtagatgatgtcttgtcatcaataattccagaatatcatcagaaatcatcaattgaagtaaataatgtttcattaagttttaatattgaaaatgataagatagataatcttaaggaatatattattcgtaccctaaaaaggaccaaagagaaaaaaattaaatttcatgctttaaacaatatcacttttaaaatctataaaggtgaaaaagtagggattattggatataatggtgcaggaaaaagcacattgctaaatgttatcacaggtatttatgaacctgatgaaggaaatgtgaaaacatatggaaaaatttctccattattgtctttaggtgcaggttttgattataattattctggaagagaaaatatctacttaaatggagcagttttaggttatgataagaagtttttagaatcaaaatttgatgaaattgtggaattttcagaacttcaagattttattgatttgcctattaaaaactattcttcaggaatgcttgcaaaattagggttctctatagcaacaattgtcgaacctgatattttgattattgatgaggtgcttggagtaggagatgtgaactttcaga

SEQ ID NO: 994 - DNA, 1024 bp, Methanobrevibacter ruminantium
atgaattataaaattagcattatcattccagtatacaatgtagaaaattacattgaaaaatcattaaactcaattatttcacagtcaataggtattgagaacctagaggtcatattagttgatgataactctacagataatagtgcaaatattataaaaaaatatgttagcaaatatgataattttaaaggaatatactgtgacattggaagtgggttctgtggcagacctagaaatattggtttaagctatgctacttcagagtatataatgtatttagattctgatgattggttagaagaaactgcctgtgaagtattatataatactatcattaatgaaaatgcagacattgtttgtgggagtcaaacaagactagacaatgagggcaatagaaaattttattatcacttatgggttactacattaactgatccgaatgaagattacaatactcgaatgaaaacaacacaggaaattatagacgatccgaattttaagttagtcgttacagatttagataaaaatccaaatattttaggacatgcaaatgtctgggggaaaatttttaaaaaggacctaataacagaaaatgaactatcatttccagaggacatagttgctcaagattcagtttttttattaaactcctttttcgttgctgaaaaaattgtatttataaacgacataattgttcattataacaatttacgttgcgatgatgatgataaatccgcttcctatgtaaaaactactaaaaatctatttggcagaatcaaagcatatgatttaatggataatattagtaaaaaattttcaaaggaagaatttttctacagatatttattagtaggcaaattaaattactggtttaattcatttttaatggattctaatattagcacatatgaaattaagcttctttttaaaaaatattctcatttatttagtaattgttataaatttaatacaaatctacgaaaagatattaaaaatatttttaaagaaatagatgagggaaatt

SEQ ID NO: 995 - DNA, 1024 bp, Methanobrevibacter ruminantium
atggataaaaatgagatatttactttatggataccagataatgacgacaataacctatcgcagttagcccacctatctttaaagtcttttttattgtgcgattatgatgtgattctttatacttatgaccatattggcaatgttcccaatggcgtttgtattagggatgcaaacgaaattttagataaatcaaaaatttttagatataaaggaggttttaaaacatattccggcttcgccaacctttttagatataaacgtctatatgaatatggaggcacttggctggatttggacctgcttttaattaaaaggctttccgatgaagatattataatcggttcccagacacaggaggacatctactccaatccaaataatgcactgtttagattccccccaaaagatcctcttataaagacaatactcgattattccgaaaaaagaggttcagatattaatcatgcagaaacaggaactttacttcttaaaaaactattggctagtgaatttccagaatataaccaatatctaaaacatttcaattattcaaatatcgtgaactggaacgatgttggggattatttagaatcaccggaaatatttttaaagtgcttaaataccaatgaaatctacggatttcatttattcaataccttctttaaaaaatttgtagaatttccaaaagattcgtttttcaccactttaaaagacataattttaaattcatccacaagtgaagagtatgcatttaatctaatgaaatacaacatcactacccaaaaacaatatattggcataaatgaatgggatttatcttatctaaatattttcaaagatgcgttttcaaaaaatgaattcaaatacacaattctaattgattcacagaatcttaaaaaaatggagatttacaacatcatccgcgccatcttcagttcatatggacttgagtctgaaaaagacattcaaatcatcatatgtggaaaaagcgacatcggccatgataaaattaaatttaaagaca

SEQ ID NO: 996 - DNA, 999 bp, Methanobrevibacter ruminantium
ttgttggatgcagatgagttcataatttctgataacggtcaaaatcctcgcgaaatcattaaaaaaattaatgaaaattattattatttaattaagtggattacatatgttccaacaaataatgatgactataatataaaatttattccaaaaaggataactcatgtacgggatgaaagtttagagcaatattataaggttattgtacctaaaaaagttgtaaatgatttcaatgttcgtgttgaaatggggaatcataatttaaaattcgataatttcaatagaaatgaattagttaaaaaagatttaaatttaaagattgctcattttccacttagatctatagagcaatgcatatctaaagtttcaattgggtggcccaatataattgcaataaatttatataacttgtcttggggtttccattggaaaatgctttttgacaaaattaaagaagagaatgatatttcgcttgatgatttagaattttttgcaaaaaattatgccttggtatcgacatcagatgatattctaataaaaaatcaaccaatcaatctagatttttgcgataagatagaaataagatatgattttgaatataattaccttagaaatattttagaaaactatgcttattttgccgaagaaattgtttctttcaaacgaaaattaaaatctgttccaattttagatgaccgtttcattcttaaattggcctctgattatgacgtcattgaaaaatcaggattatttgatgtaaattggtattgtaaaagatatagtcctccacgcaatattcatcctataattcattatttgcttacatatagggaaaatatgaatgaccctgcgggatttttttcaacggaatattattttaaaacacatgttgatgttgcaaattctggaatgaatccattcgttcactatattaaatatggaaaaaaagaaaatagaaaaattgcttcctcaaaatctgagaattttggggttcagtaa

SEQ ID NO: 997 - DNA, 1024 bp, Methanobrevibacter ruminantium; identical to SEQ ID NO: 860

SEQ ID NO: 998 - DNA, 1024 bp, Methanobrevibacter ruminantium
ttgggctttagattttcagttgtaatggcagcttacaatagcggagcatatatccaagagactctagactcactaatcaatcaaagccttgactttaaggaaaacatccaagttattatcgtaaatgatgcaagcagtgacaatacagagtctgtatgccaagagtacatcaaaaactatcctaataacatcatactaatcaacaacagaatcaactgcggccctgcccatacaagaaatgtgggcctccattatgcagaaggggagataatcaactttttagacagtgatgactacatatcaaagaagacctttgaacgtgtagattccttctttgaagactttgttcatgtggacatggcatcaatcccaatcaagtttgtagggtccaagcgtggagaccatccattaaactataaatataagggcacaggggtcataaatctcctaaataatcctgatgccatacagctatcctctgcatcagcattcttcagaagcgacattcttaaagctagccttttcaatcattccaggtctcgctacgatggatctgtctctgttgtttacaatgacaacagtcctgtttcagattcaattcctatgatattcaatgaaaacctatcagtctctgaagatgctcttctaatcaatcagatgctccttagaaaccctcttcttggaatactctcaaactgcacttatttttataggaagaaagcaactgataacacttccctaatctctgattccgccaatcacaggtcttactttacatccagagtaaataactatatgataaggcttattaacgattcccttgacctttatggaaaggttccagaattcattcaatatgtggtaatgtatgaccttcaatggatcatggagataaggcaggtggatcacctattggacctagaagaccttactcacctttatgacaagctaatctccattctattctatattggagacaaggtgatattcaatcaaaggtccatcccatctatcctaaagtcac

SEQ ID NO: 999 - DNA, 1017 bp, Methanobrevibacter ruminantium
ttgcgttatatcgcagatgagcttaaaggtcgcaagacttcagatggaaagccctatgaatttgaattcattccaaaggatgagttttcattgtctaatatgaagaaattagccacctccaagtacatttttctaactgacaacttctttgcacttgccttcatgagattcaataagaagacaaagctcattcagctatggcatggaactggaatattcaagaaattcggctatgaccttcttgaggatgaacagaagaagaccatgcttaagttttcaaacaagatcaccaatcttatggtcagctcacacaatgtgattgacatttatgcccgcaattttgcaatagataagtctaaggttcttcctttagggattcctcgaaatgactattactctccagagcatctggatgaggactatgtaagacaattgaggggcgagtttgaacagaggtatcctaatcttaggggtaaaaagatagtcctatatgctcccacatttagggaagaccctaaatacaatgctgtgtttaattattttgacattgaaaagttcattgatgagctcggggatgattatatattatgcatcaagcttcatccaaactacaataagtttgcagatagtgctaataggattgaccttgatgagctcactgacacttataacatagttaactttacagaatataaggatgagcagaagcttttcttaatctctaacattcttattacagactattcctctgttatggttgagtatactcttcttaataggccaatcattctctttgcatatgacttggacaattatcttgaaaatgagagaggattctatttcgattacagaaaggaagttccgggcagaattgtaaaggatacagatgagttggttagggtaatcagagagaaggattttaatctatctaacttgaaggagtttgcagagtttcagtttgattattttgatgcatatagcagcaaacgtattttggattatgttttggaggaataa

SEQ ID NO: 1000 - DNA, 1024 bp, Methanobrevibacter ruminantium
atgaagcttagtattatcatacctacatacaatgaagaggaatatcttcctaaactgattgaaagcataagatctcaagagtttacagattatgaagtcattgttgcagatgcagacagcaatgataacaccagagagatagctgaagcttacggatgcattgtcgtagatggagggcttccagcaatcggaagaaataggggcgctgcagttgctaaaggagagatactgctatttttagactctgacttggaattgaccgaacattatcttgaaaatgtcatagaagaatttgaagaggaagatttgggaattgcaatcacccagatgacccccctctcccaaaagaaaagggacatctatcttcataacttagccaattggtttatgatagctgtagaaaacatcaagccacatggtgcaggatgctatggaatcatatccagaaaggagctccacgacgaatgtggaggatttgatgaaaacctgacatttggagaggatacagattatattgaaagagtggctgagataagtcagtttaaagtccttagaaatgctaaaataggagtttccacaagaaggcttgaagaggaaggactttataccctccttaagcaatatggaaaaagcactgtaaatgattttaggggcaaaagaacaagcgctgaagatttaggatatgaatttggacatgaatcaagctctaagcttgaaagtggtgtgcaggaatcagttccaaaacttgaaaacggcgtgcaggaatcagttccaaaacttgaaagcagtgcagatataagttctcaaatagaagataactctccaagtcttgaagatgaaatagacattgaaagtgaccactatccaataactgctcttgacagcacagatatggagaggattgcagaaaagtccaaaaacagaaagcaaagttcatttaaaagaaggctcaatgagtttaaggacaaggaatttgaaaccaacgagcttatcgaatatgaggatgaatcaggccatataaaac

SEQ ID NO: 1001 - DNA, 1024 bp, Methanobrevibacter ruminantium
atggaaaaacaacaagtaaaaacaattttaaaatctgtggttatcatagctatattgcttattattgtttttggtcttagggctcaatctgtagatattggaggagttcctaatgaacttaaatcacactatgtagacgaaaacggtcttccttatttcagtgaaatggactcatacttcaactacaggatgaccgagaattatatggatcatggatactttggtgacactaaggtaaacggtaccggttgggatatgcattcatacttcccttcaggtagggcagtaggtgattatcaaccgatgattgcttatgtgacttcgttcctatatggaataataaatatgttccaggaaatgtctcttcttgaagtggcgttttggactggggctattgtttcctcacttgctgtaattcctacttacatattcacaagaaggattacaaacgactatggagcaattgcggcctcattgattgtagtattaggtccaaactatatttcacacacattcgcaggatttttcgatacagatatgttcaacataaccttgcctttattcttcatactgttctttgttgaagctttaaaaactgataagctatcatacagaatcatattctccttattagcagtagcttcaatagcgctctattccctttcatggacaggttatatgttttatgttgctgtaatggtattggttatgattgtgttctttgtattatgcttctatttcaatattgagattttagaaccatttaagaactatggaaataaactggaatggctgattaatcagaaggaattgtttgctacattaattgtattggttgtaggtctaattggattattattagccgtcggagtaggtggaattattgaaggtattaccggccttacaggaggtttcacccttcaagcaggtgctgctgacgtatggcctaacgtacttatttccgttgcggaaatgcaaattcctaatttagtgactggaggacttgtaggttcattcctcgcta

SEQ ID NO: 1002 - DNA, 1024 bp, Methanobrevibacter ruminantium
atgtcaagtttaatttcaattcctactttgcctttaattgttatcgcattgatatgtgggattctttcatttataagtactcgtttggttatgccttggcttattggtaagcttgagcaggcggaaattattggaaaggacattcataagtcctcccgtcccattgtagctgaaatgggtggtattggtataatattcggattcatcatagggatctttgccggaataattctctttccagtattgaccttccagcttgtggttgtccttctggttgttcttcttgttggaatcatcggcatggttgatgaccttattgtattgtcctcaaaggagaagctattccttctctttttggcaggcataccattatggtgggttgcccctcctaatgtaggccttctatatatgatcatgattccgatagcagtatcaatcacctcaaaccttaccaacatgcttgcaggattgaatggaatagaatcaggccttggggttatttcaatgacctcacttacaataagctgtatcattcttggaaagtatgacgttgcgattataagcatgacaatgcttggaacccttcttgcattcctttattataacaagtatccggccaaggtttttccaggggataccggtacccttatcattggggcgacaatcgctgcaattgcgtttattggaagggtaaagctcatagcattcattgtccttctaccgaacattatagatgcagcgttaaagttctacagtgctggagttatggaaaggcagcagcacaatccgactcagcttaatgaggacggcaagcttgtaaggccggagcagggattcaaatcccttatcaggcttgtattgagaaagccggtggatgaaaagactgctgtgatgatgatatggggaataggcattatttttggtattcttggtataattgttgcactgctgatgcctggggtaactcatgatcagacatttgcacagtttatacacttgaaagattatttctattatttgggct

SEQ ID NO: 1003 - DNA, 135 bp, Methanobrevibacter ruminantium
atgaaagttgaaataatgattatagggatcttgctgctttcaaacttcctatatcatcatgaggatggaaatcctattgtgcagtatgtagcatatattgcctcattgcttgtcataattttagggttcttttaa

SEQ ID NO: 1004 - DNA, 1024 bp, Methanobrevibacter ruminantium
atggaaaaatcagtcatactccttgctgcagttgtatcctttgtcactgcattccttgcaaacatctctgtagctttgcccttaatagcaagggagcttgcaatgagcaatatcattcaaaattgggtagccacaatctaccttcttccaattgccatgctttccatccctttaggaaagcttacaagcaagcatggcctaaacaagtcattgcttgcaggaataatccttacaataataggagtaatcatagcctgcttttcaatcaacagtgaacttctacttctatcaagggtaatccaaggaatcggaaccgctttaatcaatgtcgcttcaatggcattaatcgtttcagcagttaacccagaaacccggggacaggcattgggactgaacattgctggagtctatataggactctcatcagcccctgtaatcggaggccttgtcatctaccaccttggctggcagagcatattctatataatgctaatcccactaatattctcagcctacctgtcatggtcactcaaggatgaatggacaatgtatgacggtccaatagacataactggatctatcatattttcaataggtattcttctagtaatctatggattcaccatagtaaacacatggcttggcatagttctattgataattggtttactattattaattgcctttgcttattttgaacttagggtcaataatcctgtctttgatgtgagactctttaagaattctaggttctcctcttcaaatattgcatccttgattagttatactgcaacttttgtaatcacatacatcttaacttatcattttcagtatattatgggctttgactctaaattttcaggcatgttattaatagtaacacctgtcatgatggcaattctagcacccctatcaggcaggctatcagataggatagatcctcaaaagcttgcagcaataggcatgggttttgtaacagtggcactaacaatcctatgcttcctaaacgaatcaaccccattat

SEQ ID NO: 1005 - DNA, 1024 bp, Methanobrevibacter ruminantium
atgaattcaaaacaaaaaacattaataatcctaagtctaagcctaatattgctagcatccatagccgcagtatctgcagttgattacaccctaacaaatgcagatatggactatgtggttaagtctaacggattattgcatgtccatgaggcaatcacatatgactttgacagcagccccaatggtgtctatagagacataccccttaaaagcggccagtccatagagaatctggaggtttatgttgacggggcctatgcagagtaccagatcattccaaaaggaagcggtgagaggataaaggtatatctctatacagactcctcaaaaagccataagctatcttcagactctgtaataaccgtccattatgtctatgacatgccaaaggttgtaaagatctataacgatattggagagctccagtataaggtatggggtgatgaatgggacgaagaccttgaaaaccttcaatccacaatcacattcccagatgatgaggagcttcagttctggatcaacccatacttcagcaatgctaaggccagatgggcagaggaccacctgaagatacactcagactttgtaggagacggcaaatatgttgaggcaagggcattgattccgttaagcgaattcgattccaatgcagaatatgcacagcatataaacaagaacggaaaggatgagataatcaagatacaggacgatgacaagaaatctcaagagggcttcaaatccttattctcaatattaaataaggtattggtagtgctatgctttattccaggactcatctaccttaagttcggaagggagccaaagacaacatatgatgcaatatatgagcatgagcctcctacagatgaccctccagcctatgtgaatggtatgataggctcagggctaaaggatgtaggcagtctaaatcaggaagctttccaagctacaataatggaccttatcaacagaggcaagatgggtgtatcctcagaggaagacactgaatttacaaagacaacct

SEQ ID NO: 1006 - DNA, 1024 bp, Methanobrevibacter ruminantium
atgaacaataagcaaaaaacattagcaatcctcattctactcgctattgttttaacaagcatttcagcagcatctgcagtggattataaaatcacaaatgcagatgtccacttggatgtggaagacaatgggatattgcatgtcagcgaaaacataacatatcttttcaaaagcgacggacatggtgtctatagggtcatacccctaaaggcagatgagaagatgagctatctgacagtggatgttgacggctcatactttgaatataatatcattaaccgttcaggggaaaaggaagtaagggtatacttatataaggataaggatttaactgattacggagtaagcgaaggctctacagtcactctaaagcttgactattatatggaaaatgttgtaaagctattcagagatacaggactcctagaatacaagctctggggtgaggaatgggaccaaggagttgagcatctaaacgcaaaggtcacattcccaaatgatgaggagattgaatattggattaatgacgattccggaaagacagaatcaagcttctcaggagacacactatatgtaaagggctcagacattcctaagggagattatgtggaagcaagagttctcattccattaggtgaatttgattttgatgcagattatgctctacattacaatcatgatgcctctgatgaggtcaaaaagcagcaagaggattttcaaaaaaagcagcaatactttaacaccattggcaatctattaaacgttatatatggcattcttatcctcacgcctttaggcatatatctcaaatacggcagggagccaaaggtgtcaagtgatgccatatatgagcatgagcctccaacagatgactctccagcctttgtaaatgcaatgatgagtggattgagtaaggatgttggaaaggttgataagaaaggtttccaagccacaataatggatctcattaacagagacaagcttggaatggaaatagcatatacaaataagaaaagacctgtgt

SEQ ID NO: 1007 - DNA, 1024 bp, Methanobrevibacter ruminantium
atgaatcttaaacaaaaagcaattatcatgctcatactctcaatacttctaatgtctgccatttcagcaagcgactataaaggaagctatatggattatgtgcatatgaacgtaaacgaaaacggtttggttcacgtcaacgaaagctttacatatcaaatggtatctccagagtctgaaataagccttcccctctatcatggcaccaatgcaagcattgaaaatatccatattagggtcaacgatctcttggttgcctatgacctcaagaaaggggacactctagatgagctagtcatacatcctaagtcttcagattatgattatgactctgaaagcacaggcacatatcttcttgatgtggaagtcgaatatgatattgaaaatgccgtaaaggtctataatgacgtaggggcattcacttaccaaatcaataaaacagattttaatggggtttctttaggaatggcccatataagaatcaagttcccaggcactcaggagcatgaatacttcataattcctaaagagggcgaaagcagtgcccaatgggatgaggaccattttcatatgaccaatagccagcctgcgaaagcaactgtcataattccattagatgaattggacgctgatgcaaaatatgctcagcatattgattctgacggattggaagcgattaaaaacgactcattcgatttgaagtattccctaattcagatagtcaacatactgataaaaatctttgtaatcatcgcattcatccttccggttgcaatatacctgaaatacggaagggagccaaaagtgacccttgacagcatctatgagcatgagcctccaacagatgatcctccattctttgtaaatgcaataatgggcggaacctttagggacgtcgggctagtggatacaaaggcattccaggcaacaatcatggacctgataaataggggaaagctatctgttgaaactgaaatcaatgaaaagaacaagcaaaggacatatcttgtggcaaaatcaacag

SEQ ID NO: 1008 - DNA, 1024 bp, Methanobrevibacter ruminantium
atgaatataacagaaaatcagtctgataatgatgaaaaaatattaacaaagtcattttgtcttatttttggagctttgctctttacagcccttgtaatgtatgcattgatgtccactgtaacagagtatgccagctctatgggttccactgcaactattgcaggtcttgtatctggaatatatgtattcggtgggctttgttcaagaatatattcagcaaatgcattggaaaagaaggattggaagaccttagccctaatattcctttcaattcactttttagcatgcatattgtacttctttgtcgacaatgtcgaattgcttattttagtcagattcatccatggccttggatttggagcttcagcaaatgcaatagtgactattgcaagttcaattcttcctaaaaaacgctttggagaggctttcggatactttatgcttggaaccactatcgctgtaggattaggtccatatatcagcggattcttctatgatatctggggctctttcggcagctttcttctagctactgtattctcattcatagcattggtctgtgtctttttccttgatatagaaaggtatcatccagatgaaaagataaataatgaagatattttatctgatgctgaatcagtaggcacagaatctatagatgcaaacccaatcaaaaaacaaaaggaaaaaagaagcttcattgaaaagatatttgaaatagatgctatccccgtctccctatttacagcattgactgcacttggatatgtgtccatactctcattctataggctttatgcagtggaactggacctggttggcccattctcaattttctttttaatctattcagtcatcctagttgcatcaaggccaattgcaggtaagattcaggataaaaatggggataagatcatctgtgtaataggcatagttgcacagtcaataggactcttccttatagcttatgctccatctgacataacaatttatatctgtgctgtatgtgcggctttaggttttg

SEQ ID NO: 1009 - DNA, 1024 bp, Methanobrevibacter ruminantium
atgggagagaaagcacaatgggatagttccctttcatttatatttgctatgattggagcagctgtagggcttggaaacatatggcgtttcagctatgtactatactctaacggaggaggatcattcttcattccttattttgtagcaatagcaatcatgggaattccttttttaatacttgaatatggtgttggattcagctttaaggattcgttcacgaatatcttaaagaaaatagatggaaggcttgaaatagtagcctggatactgattctttttgtatttatagttgtaatttattatatggtcatactgagttgggatatggtatatctgctgaccagctttacatttggctggggagtggacactgcagcttactttacaaatacagttggaggcagtgcagatttggcaaaggggggaatctttttaattcctacaaccatatgcgtagtccttatgtggattgtattatggtttatatcccatagggatgttgacaagggaataggaaaggtttcaaaagtattgatcccatccctttttgtcatcatgggaataatcgtattctattcaatcacattgccaggacatatgataggaattgatgcattgcttcgtcctaactggagaatgcttcttgatgtcaatatctggcttgcagcatttgcacagatcatcttctcattaagcatggggcaggcaatcgcccttacatatgcaagctatcttccagagtcctcaaggctcactgacaatgtattgatagttgtcgcctcaaattcattgtttgaaatattcacagcatttggagtcttttccatattgggatacatgtcattgaattctggaatggccttaaacaaattggttacagaaggaacagggcttgtatttattgttttcccaatgatattcaatgtcatgggtacggtaggaagagtattggcacctctcttgtttttagcaattctatttgctggaatcacttccgctttaggcttcttcgagcctatgctaa

SEQ ID NO: 1010 - DNA, 768 bp, Methanobrevibacter ruminantium
atgaaagaaaataaagaaatgaactggaaaattaaatttgcaattatcatgtttgttttggcagttcttattttccttgctcgataccttatctgcggagatggggaagagatcatcgcttatctttggaagcatatcggatttattccaatagatatcctcattgtagcattggttcttgaagagatcatgggaagaaaagagcatgaagccattttagagaagatagacatgcttatgggtacattcttctctgagattggaaatgatttaattgcagaattaagcaaggccaatgtaaataaggctaacactgatgatttaaaggctattaaatcatggaacgataaagattatgataataaactaaaagaattgaaaaacaatcctgtagactttaaggccaatatcgctccagaggaaagggaagatttcttaaacagaatccagagcttattggttgaaaacagagaatttttagtaaatcttatcaataaccctaacttgcttgagaaagatgaattctcatcacttctgcttgcattattgcacttggatgaagagcttgcaagaagaggtgaattaactgacataaaggatgctgatttcaatcacttgaatggtgatatgaaaagggtttattccaaattggtttatgaatgggtttattatttaaaataccttaataagcattatccttatatgatatctcttgctatacgtaccaatccgtttgatagcgaagcagatgttcatgtgactgaataa

SEQ ID NO: 1011 - DNA, 702 bp, Methanobrevibacter ruminantium
atgatagaggaattagtaactaacatgtctataacggaaagcggagcttcagccagctctccaatatttacaataacaattctagtctttacaatcttgctccttataggcataatatattttgtctttaagatgtatgaacagtcaaagcctacagttgaatcaatcgttctaattgccgttttaacagctattgcaactgtgggacgtcttattctaatgtcaatacctgctgtaaacctggcatcatttgtaataataatggtgggggttgtctttggcaaggaggaaggtttccttgtaggtgcccttacagcatttgtttcaggcatattcatgggaatgggatattgggtcattttccagatgcttgcttggggacttatgggagcaagtgcaggatacttggcttcaaggtttgacagcttgccattcagattcatattcggactcctatggggattcctttacggctggataactgatatttcagctatcttctattcaggaaccgcattgcagattactccaatcattgcattgtacattaacggtttcacctatgacttgactcacggagtaactaatgcagtgcttttagtcgtattgtatgactggtttaagaagatgtttacaagagctaagattaaatatctgtctaatccaagctcaagtgatgaaagcattgacttaactaattaa

SEQ ID NO: 1012 - DNA, 1024 bp, Methanobrevibacter ruminantium
atggaacttacagctattcatccaggcgtatatttgctttactattttataatggttctcttggctttcatttttagcgatccttattttgtattgagttttttagctttgattcttattcttatcgctcttcagggagtctccagcgagctaaagaacataatgaaatttttcatacccttaagcgtactgattataattctaaatcccctcctgaatcggacaggggcacataggatatatcttttcaacggattcttcatcacctatgaggcaattgcatatgggatattgatgtcattggcacttctcattgtaattctggttttctcatcatataataggtcagtttcctatcaggagatgctttatatcttttctaaaaagcttccaatcatctcaatgataattgtaatggcattaaggttcattccactaatcaattcaagggccattgaggttcaaaagctgaataatctgaaggccaatggggtagaatcagatgaagaggatgatttaaatgatgattctcttgaagacaatctttctgaggaaaataatctttcagatgaaaataattcaaaagaagattcagactctctcgatttagagcaattcgactcaaacatatcaagcctggacatcggttccgattcaagggtcttcaagaagataaagtcctctaaaaggttccaatccattgcaaaggaggcaaaggtccttggaaagatcatgggaataacagtctcatggtcccttgaagagtccatgtttacagccaagtcaatgaaagcccgtggatacaactccaatgagcgaacaagctatctttcatacaagttcggacttgcagacatcatattccttgcaataatcatagtcacagtatcaataatagtgataggccttatacaaggatatggcatgataaacatttatccttcaatagacttctcattcagcgatttaccatttaacatttattattttgcatttatagtatttttattacctttaatctatc

SEQ ID NO: 1013 - DNA, 786 bp, Methanobrevibacter ruminantium
atgatggatttaatctctggaataatatatctaatcctattcattataataatggtctttgccttttcaatgggtattctctcaccctatgttggaaggcgtgaaataatttccattattgcaataggatttgttctcggtgctattggcggatacttctttatatatcctatgtatcaggacagtccctatgtattgggcaatctccagggattgtttacaatggaaagtgagataataaacctgaacattccatcgacatccaatatcagtgatgtcactgaaaagattctaaatcaaaatggggtcaattcagtaagcactaatggatttgagcttacaacaagctcgataaataatgaaacgaaaacatatattgatagctatcttaagaatgattctcagatagagcgctatagcataggaaccaataatatttccgttgacctaaagaacgatgcaagctcaacagccacattgggatcccttgttacttggctttccaatactgttggagtgagctcggaatttgcctttgttcacattaaggttaatgtgaatgcaaatcaggttctggatatcaaggaatatttaagggacaatcattatactatagtctcagtagaaggccctgttcaggataccattcattatttctatgatcatctggctccagattatgttgtaatgtgcattacaggcataattggtgtattggttgctattgcaggcatatatgtagagcctttaaccaagtttgtaagagcctttagaagagggggataa

SEQ ID NO: 1014 - DNA, 855 bp, Methanobrevibacter ruminantium
atgtctggcttcattatggtattctttacactcttattggctaactattatgatctgaagtatgggattattccaaataagttaagtgttttccttatgacatttgggattctaataaatgtattgattttaattgtccttaataatcgattgtacgcaatattttatgtatcttatttaattataatttttattatctcatttgtcctatggaaaatatccttttggggaggtggagacctgaagctattctgttcaatagggttttcacttccctttatagatattctgaatcatttctatactggcagcatcttaaatagcttttcattcaatagccagataattctttatcctaagatcttttcaatactgataaattcaatcttattgtcatttccggttattctattactgcttgtttataagttgcttagggaaaacaagctgaacttgatattatttgctttttccaatatgaaattgctcataaaggaactgtcaacaaagacagtatttataaatgacctgaaggagggaatgattgtagaggattattatttcaatagcttggagctatttaacttgatggaagagctgactggaaatgaagagtgctacaatctaaaagcaagtcaatttaaagagaattcttatgtccttaagtcatcttcaatggcaggtctgacaagggatgacattaaactaatcaattttgcatatatggaaactttaataaactttcccaattttaaaatcaaaatgggagttccttttgttccctctttgactgtaggatatttggtattcttggctttcggtgatttggtgtttttaatttcaacaataatctaa

SEQ ID NO: 1015 - DNA, 1024 bp, Methanobrevibacter ruminantium
atgagtgataaaaatgaatggggcagcaatctatcatttgttcttgcgatggtaggttctgctgtcggacttggaaacatatggagatacccgtatgtattatacagcaacggtggaggggcattctacatcccatatatcgttgccatactattgatgggaattccatttttaatattggaatatggcgttggatataatttcaaatcatcctttccaaaggccattcgcaagattagctccaaagcagaatatctaggatggctgcttcctacctcagtattcatcatcatgatatactattcatgcatactgggatgggatggaatctatgtgatattaagcttctttaagggatggggagcagatccaaacacattctttgcaagcacattgctccagtcaagcgaatctgtcagcggaataacaaactttattccagtcattgcaattgtaatgcttataagctggggaatcgtttggtacatttcccataaggacttggaagagggccttggaagggtgagcaagattcttgtgcctttgctttttataatcatgattgtgattgtattgttttcattgaccttgcctggcgcaatgattggattgaatgaactcttttcaccggattggaacttgcttttagacttcaacatatggatggcggcattcggccagataatattctcccttagcctgggaatgagcattgcatttacatatgcaagctatacaggaaaggaaggagacattattacaaatacactggccattacatttgcaaattgcgcctttgaaaacttctgtgcattgggagtcttttccattcttggatatatgtcccttcaaagcggaacagcggtggcagaccttgtaactcaaggtacaggattggtgtttgtagcatatcctacagtcttaaacgtattgggacaatatgcatatgtaatcggacctttattcttcataacagtctatcttgcagggcttacaagcatcctatcaactattgagccattgt

SEQ ID NO: 1016 - DNA, 360 bp, Methanobrevibacter ruminantium
atgatagacagttttagatatgcattaaatggaattgcagtttctattaaagatgagagaaacctgaaaatccaaatgattgttatgatgcttgttataatagccggatttcttttaaagattagcagaacagaatggataatttgcataatcctatttgcacttgtaataagtgctgaaatgataaacactgccattgaaaatgctatagactacaccagagaaatgactgttgataaggacaatgacttagccagaattgctaaggatgtctctgcaggagctgttcttgtaattgcaattgcatctgcgattgttggattaattatttttattccgaaagttctcttattgctttaa

SEQ ID NO: 1017 - DNA, 153 bp, Methanobrevibacter ruminantium
gtgatttggagagagaaaagccttaaagatgtccttgagatagcatttgctcctttgtttttctggctaattgaaataggatttgcattgtttgtcagtttattcattggagtatttattgatatgattatagggatagaagctatggtttga

SEQ ID NO: 1018 - DNA, 1024 bp, Methanobrevibacter ruminantium
atggtagtacttagtgcaggagatactgcatgggtgctcattgcaacaatccttgttcttttaatgagcatccctgaagtagctttcttttatagtggtttaacaaaacgtaaaaatgtcttaaatacaatgtttctgacttttattgcattttccatagcaagcataatatgggttgtatatggatacccatttgcctttggagatgtcagtataagcggtttgatagctcaacctgctcatttcttcatgagcggaatcggaattgaagatcttacaggaaccatccctacaatattgtttattgtgttccaattaacctttgccggtcttacagcggcccttatctcaggttcaatcgtcggaaggatgaaggtctcagcatggatagtcttcatcattgcttgggtcacccttgtttatgtaccgattgcccactgggtatggggaggaggattccttatgcagatgggttccctggactttgcaggaggtacagttgtacatattaactctggtgtaacagctcttgcattggcccttgttctcggaagaagaaaagacacttcccttttgccacacaacttaggatattcagttctcggtgcaggattcctttggttcggatggatgggattcaacggaggatctgcccttgcagctaacggacttgcagcatcagctatccttgtatcaaacgttgcagctgcaacagcacttatcacttgggtaattatagatattgtaaaagtcggaaagccaaccatgttaggggcaatcaccggtggagtggctggacttgttgcaatcacccctgcagcaggattcgttgatgttccagcagctattgtcattggttttgtaaccacattcgtatcctactttgcaatctattacttaaagacaagattcggctacgacgatgctttggatgtatttggagttcacggtctttcaggtatttggggagcaattgcaaccggtatatttgcagttccagcagtcggaggtgcagcaggtttgc

SEQ ID NO: 1019 - DNA, 552 bp, Methanobrevibacter ruminantium
atgaacatcttaaatctgccacttaatatcctcataggaaatggaatctcattctttgcctcaattgcacttatcctaagctgtgtagtcaatgacaagagagaggcctataaatatcaggtcattgaagcccttatcctaacggtttcatcagccttcttcctctcatggactggcatacttacaatgctcattgcagcggcaagaaactatcttgtcatgaatgagagattaagctccagattggccataatctttatcataataacactgatcatatgtcccctaattaatacaatgggccttatcggacttcttcctatgattggaataatacagcttacaatctgcaactattatcttaagacaatcaaatggataaaggtggcattcattgtaaatgtattgatatatgctgtttacttcattggaatctatgaccttgtatcatgtgcaacccaagtgattacagcaataatcggattcatatctttagtaaagctaatcaaggatgaaaaagagggcaatatagactctcagcccaataattaa

SEQ ID NO: 1020 - DNA, 273 bp, Methanobrevibacter ruminantium
atgtctgatgatgaattatatagaagagctgaaagaaaagtggatgaaaaaattggattttataagcatttatatagctatattggtgtaaacatacttctttttgccataaatgcaatcacatccttcggcaaatggtggttctattgggtaactatcttttggggaataggcattgtaattcactttttaaaaacatttgtcttgactggaaaacttgaagacaaccgagaggaaatgattcaaaaggaaatggaaaagatgaaaaaataa

SEQ ID NO: 1021 - DNA, 951 bp, Methanobrevibacter ruminantium
atgaaaagactttttaagctagttgaaaaatatttctttataatcatcataattgcagttgcaattgcagttgtctttccaggctcattcgattgggttatgggagagtttatgggtatcaacatcataaacattctacttggaataatcctttttggaatgggtaccactttgaagatagagaattttgtaaacgtattcaaaaggcctaaggagatattgcttggggtcggcgcccaatatatcatcatgcctcttgttgcaattggggttgccagcctattcggcctcaatgaggcattgacagttggccttgtccttgtgggaacagttccagggggaaccgcttccgatgttatcacattccttgcaaagggggatcttgcactttcagtatcccttactgcagtctctacagtcatatcaccgattcttacccctttaatcactctgattcttattggaaacaatattgcattcaatcctgtggatatgttcatttcaattgttcagattgtaattcttccaatagctattggattgctcttgaattacaagtttccagacttctgtgaggagcttaaggattatctgcctgcagtgtcctctcttgtgattgcaataatcgttgcaggtgtgataggtgcaaataaacaggccattcttggctcatctgtggtgataattgcagcgatcgtggtgcaatacttcatagccatgcttttaggatttgtgataggatatctctctggaatgaaaagaaagcagatggtgaccatagcaatagagcttgccttccagaactcaggattgtctacaagccttgcaaagactcactttccagcattgtcccttgcaactgttccaggagccttgtattcagtatggcaaaactttgcaggttccatacttgcatatatttttagaaaatatttcactgatgaggaatag

SEQ ID NO: 1022 - DNA, 1024 bp, Methanobrevibacter ruminantium
ttgaacgaagagcattacaataagcagctattaagggattatcaagaaagcactgatttaagtgtttatgatcatagagaagagatagattatgatgaagatgttgatataagtctttgtggatgtcctgattgtgcggatgaccatgaccataatcacgaccatgaccatgatcatcaccatcatcatgaccatgaccataaccatgaacacagtcatgagcatgagcattcttatagtcatgagcatgagcatgagcacagtcatgaacatggccacgagcatggggatgagcatagccacgaacatagtcatgaccatgaccatggccatgatcacgagcatgagcatggggatgagcatagccatgaacatagtcatgaccatgagcatgagtctgaggatacttgtggatgcggttgcgatgatgatgactgccatgatgatttagaagaacatagtcatgagcatgaccatagtcacgaccatcatgaacatgaccatgagcatcatcatgaacatgaacatgaccatcatagccatgagcatgaagatgagcaccatcataatgaagaacattctcatgagcacgaacacagtcatgagcatgatcacgaccatgagcatcatcatgagcacagtcatgaccatgaccatagtcacgaccatcatggacatgaccatagccatcacgaccatgaccatggagactcctgcggatgtggagaggaccacgatgatgacgacttctcattatgtgcatgtcctgactgtgcagatgatgacgatgatgaccatggccaagaggaactcctcgcagagggaaagccactcatatacaacagacctattcaaatcatggtttccagtggaatattgtttatcacaggccatatcctcgaattcctctcattcagcccaacaattgtcacaataatctacatgcttggagcacttatagcaggctatgagatagcaatccttgcatacaagtcccttgtcaagcgtcacactgtcggtcctg

SEQ ID NO: 1023 - DNA, 1024 bp, Methanobrevibacter ruminantium
atgagtgaaagtattactcctaatggtggggctaaatattcaaataataaaaacaaagcccttgccagcaagaaaggcaatgattcctactataaaaatgtccttttgataggaagtcccaatgtaggcaaaagcctgacattcaataagctgactggaatgacagctatggtttccaattatcctggaaccactgtggatatcgatgagggcaatttcacatatgaaaacaagacagttcatataacagaccctccagggctttatgatctaaacacaataaccgaagaggaacgtgtagccaagctattggtattggacaaacgctttgacttgatggttcatgttgtggatgcaaagaacatagaaaagtcaatagaccttaccttgcagcttatagatgccggaaaggaagttatccttgtattgaacatgatggatgagcttgagaaaatgggtgcaactgtagatgccccgtcattgtcccatgagcttggaattccagttgtgcttactgcagctgcccaaaaccgaggattggatgacttgaagcatacaatcgtaaactatgattcaatagagaatcaaatcttaagcgagtctaagacattgttggatgtcgattatggaaggtcaattgaaatagcaatctctgagattcaaagaaatatcaaagggaattatccggtttccaaaaggtatcttgcagtttctcttcttgaaggtgatgaggacagcgaagaccttctaatggaaagtgaggattgggataatctatcccaggtcattggtgctcaaaaggcaaaattcgaccagcctgtcaagtatctgactaagttgcgtcttgcagactatgcaaaacatataaagtcaagttttacaacaatagacagcgtaaacattcaggataccgacagccttggagaaaagctaagcagaatcatgatccatccattctatggtcttatcatacttgcctgtgttttgttctttggcctttatcttattgtaggagttcttggtg

SEQ ID NO: 1024 - DNA, 405 bp, Methanobrevibacter ruminantium
atgattgtgggaatcttgtccattatcttagcgatagttgtttatttcattacacctccatatattgaattttacttgatatttgtatttttaattccggcaatagccttgattgttcctaatgatgcaattaaaaatagtagagcaataggtgctcttacttttattttagtcattattgtagcatattttgcaattagtggaatgttaggggcctatgatgttcttacaaatatgtatgtcaacggtttaattaactctactcctagtacaagtgatatcagtgcttgctctaatggctatttgatggtattgatttatgcattattcaatatattttgtggagcattgttctttaaacgaacaagtagtattgatgatgttgatgatgaagatgcattttaa

SEQ ID NO: 1025 - DNA, 777 bp, Methanobrevibacter ruminantium
atggcttcttgtaatataggaaaaaaattcatagcagagcttataggtacctttttcctagtgttcttcggtaccggagctgctgttgtaactttacttatttctgatagcgtaactccaggaaaagctggcatcggattgctcggcggtcttggagattggatagctattgcattagcattcggtttaactgtaatggcatgtatctacttgtttggaaagatctcaggtgcacacttgaaccctgcagtaacaataggactccttgcaagcaaaaacatctctgcaattgacagtatctactacattgtagcccaagtaattggagcatgtttaggaagcttattgctatatgtatgtttaggagctcaagctgtaacaattggaggattaggtgctaccgctccaggtatgggagtgggatatcttcctgctttgattgccgaatgtataggtactttcttccttatgcttgttgtaatgggcgttgctgttgatgaaaaggcagaacctggatttgcaggtatttcaatcggtatgactgtagcagctgtaatcatcgttttaggtgcattcaccggtgcttcaatcaaccctgcacgtacctttggtccttacttgatggacaccttgcttggcggaaccaatttctggggattcttcccgatttacttgattggtcctatagtaggtgcagtccttgcagcaatattatatggatacttagctaaaggcaatgatgcatgtgcattgccacaacctttctttgaagaatag

SEQ ID NO: 1026 - DNA, 1024 bp, Methanobrevibacter ruminantium
gtgtatctgggaagctcatttgcattcattgcacctatggttgccggatatgccatcggcggaaaatcaagtatcttctcagcattgatggttgtaggtttggtctatgttgcaattgcaattatcatcagggccaccggtaaggaatggatcaataagctattgcctcctgtaattgtaggtcctatgattatggttattgggctttgtttggcccctaccgctattcaggaaataggacttgatcaggctgtagttccaatcaataacattattgtggctcttgcagcattcctgaccactgctgtaatagcaatccgtggaaaaggagtattgaaggttattcctttcctcattggtattattgtagcatatgtcgttgcagcgttattaggtatggttgacttttcaggattcttttcagcaagcctctttgaagttccagagttctatatgccgtttataaactacagcttcaatcctacagctcttcttacaatagttccgattgctcttgtaacaatggtagagcatgttggggaccacaaggtattaggggaaatcattggacgtgacttgattcaggaccctggattgaacaagacccttcttggtgacggtcttgctaccttctttgcagcgctcctcggtgggccagctaacaccacttacggtgaaaacacttctgttgtaggtcttacaagagttgcatcaatctatgttatcggtcttactgcagtgtttgcagttatctttgcattctccggacacttgactgcacttcttgccgctatgcctaaccctgttatcggaggtgtggctattcttctttacggattcattgcagtaaatggtgtaaagctcttgattcaagaggaagttgatttcaacaataacaaaaacattgttgtagcagctaccatgttggttttaggtttaggtggagctaccttgtccgttgctcaaggtgacttatctgtgtcaatttctggtatggctcttgctgctattgctggtgtaatcc

SEQ ID NO: 1027 - DNA, 1024 bp, Methanobrevibacter ruminantium
gtgtatatcaaaagcttttttaatgatttgaacttgaccaagaaggatggcatatatctgctggcattgactgttttttcaattctctatacagtccacctaatcgatgtaaactatacccttaactttaaatcagacccatttgtctatttaattaacggtttagtctatgctggaatgcagggccatatagagaactattcctatggaatgttcctaacacctgtcgtatcattcctgacatcacttctctttagaatgggaatagtggacaagatagcaataatgatcgttagcggagtcataagcatccttggtgaaattggattgtacctactatttaaaaccaagttcaatgaggtctactcctttttcggctgcatcctatttgcaagcttccacatagtcctcacaatctggggcgggggaggcatagacattccagtatgcgccttcagcatcattacattcctattcatggtattggcagttgacaaaaaccctaaatactacattccaacttcaatattcctgattatatcaatattcacaaaatatgatgcattattcataatacctatattgttcttatactacctaactaaacatgacttcttcaatcttgtggatttggcattaagcgatagggatgagcttaagatagttattaagaactatataaaaagcgaagagtttaaatacattgtaatatctctgattatagctgttgtcttatttatactgttttgtgaagtgatatggtcatatggagctaatctgacattcctgacacaatctcaagagtctctaaacggattcaacagtgcaaaagcagcgagaagtcatttttactataacgataagaagttctatataagaaatctctacactttcttctatcctcaaatcagccaagagttttcattgatcattcctgcaatcatagcaatcggaacagtgttcaactttgcaaacataatcagaagaagaaaggaataccctatggtgagagattacaagacac

SEQ ID NO: 1028 - DNA, 513 bp, Methanobrevibacter ruminantium
atggcagctataatatgtccaagatgtggaaaaatgaatgatggaagcttagatttctgcatctattgtggaacttactttgatgattataatgaagaagacaacaatgacaatctcttttttataagatcaatgaccaatgatgggagacctggcaagaaacaagtggtcagattaaatgaaatgccagataatctccaaaaacctaaacataggcttgccatacttttaggatacctgtttgcaatattaggcggacttataggatttgtctttgcaatttatctaattacaagaaaagataagaatgccagaaggcatggactaatccaattggttattctattaatagaatatgctttaataggtgttttaatcttaaatggacaattggatataaatatggttttagatcctttcaatatgactcgcatgaataatataactcaattatataattccagccaaatgaatgttagcgggtctaatatctcaagtttatttggcttttaa

SEQ ID NO: 1029 - DNA, 333 bp, Methanobrevibacter ruminantium
atggaagaattatattatatgatttatattatagtttttatagtaggatcaattcttggcctattattaagctataagaagcatatggaaccttttataatatctgaaattgatgttttaaccttagttttagctatagtcggatggtttttattattaaaccatggcttgattggatttgttagttctgtaattcttctcaccatagcattcttctgcattggtcttgcaataggaagaaggccaggatatggtagaaaggaaactgcaatcggaattttggttgcagtaattgtctggattttaacatctggagtcatatttaaattttag

SEQ ID NO: 1030 - DNA, 861 bp, Methanobrevibacter ruminantium
atgaatctaatggctcagattttaatcaatgtagtaatagctttccttgcaggtagtcttttattaggtttccatagaaaagtcatggcgagagtccaattaaggccaggacctcctattattcaatatctattgcattcattgaaatttttctttaaggaaacaagcttccctaaaactgcttcaatgccattttatgtgggaattacagtaatcctagcaggtatttgggttaccggagtaattgttggtccggtttgcaagggttccttaatgataatattcggtatctatgcaatccataagattgtagagcataatgcaggatcctcatcaggttccccttacggtaagctaagctgtgtaagggctgtattctcagcggcaggagaattgcctctctttgcagtaattgctgttgtcttccttctaactggaaccatggatattggtggaataatacaatatcaagcagcaaacggtcctttggcatttaaaatccctcttgcagcaatcatgttctttacattgatagttacaaaatccccttattctccttttgcaataacaaaaggaaaggaaatcattacaggatttgaaaccgagcatttcggtatgcttagaggatatataatgttttcagagtcaatcgcttggtatatcttgctatggctcttcttgacaatattctttgcaccgataggagtggtgggataccttataggaatgattttgatatgtgtgattacaggatttatcaatgctacaactcctatgttaaatccaaaccattctgtaatggctcaaatatccattgcagttatttgcgttgttggttcaattatcatgattattatttaa

SEQ ID NO: 1031 - DNA, 669 bp, Methanobrevibacter ruminantium
atgcttatagagaacttaggtggagactttttaggaacaatccctcttggagatattgttctatacttaaacccgctccatatattcctgtttgttactatacttctatttacagctctaatagcaatcagtcgtactgaaacacaagttgaagctatgtttggctcacttgatgagaataaggttgcagtgggactgaaggagtttaagcatagaagattcttagcgataatatgtggtatagcaacagcgggagctatgattacaggggacctttttaacttcaccctatttatggccttgattggtattgtcaatattggtatcgtttcagctgtaaagcaagtggaagtcttaaattcagcttatcagtatggattgattgccatgatgtgtggattgccattgtttggtggagcagctataatattggcagctacaggtaccttaagcttgtttgagcttgcaagcattccagcaaatcctatgatgatatttggagcacttgttatgctaattggagtctgcggtgaaagcggtatagctccattctttgcaagcaaggcagagatgtttagaactccaggatctccattcattttgattattcacttaagttcattgttccttatagttagatttattgaaatcctattgactatattgtaa

SEQ ID NO: 1032 - DNA, 678 bp, Methanobrevibacter ruminantium
atggtagcaagcgtaatccctcaagttgttccggctttctatagctcaatgtataccacagccttatatggtggtttgattgtagcttttattggcttgattggagtggcaatggaaaagagagacattcagattcttattctaacagatatagttggattggctatgcttatcgtcgtagctgcagttggaactgacttgtctgaagcattgatccttccaggtctggtagttgaattggcagagatcatggcaatttcagagatattgatatctcgtgagatgagaaaggctgataaagatacctcatttagcccaatgcctttagatattgatatggagattatgacaactgctcctaacttcattgcattgcttctaatcggatacggcatattcctgtctggttttaccggcggtgcagtagctggcggaggtatcgtcatttatgtacttagtagaaaggttagaggattgccgatatttgttcttgatggcgtaggagcaatatcaggtatttcctggtgtttatggataatcggtttcatattcttcttcatccttccgcaatactggcttttaagcctattccttgcagctttaggacttttattaaaggttgcttcaaagatcggattgattggaatacttatgagagaggaatatggaagaaaataa

SEQ ID NO: 1033 - DNA, 342 bp, Methanobrevibacter ruminantium
atgttggaatttataaatatagaaacaatatcaatggccttaatgattataggtgccattggagttgttcttcttaaaaaaccattggataaaattattatggtttcagttctggaagcaggtctgtttttagctatcgttagctttaaataccttgatgtggccttcctaactgcagttctcgatccattatccatcattgtattcttacttgctttaattaaaatcaataaagtgcgcaagtctaaattagaggactattccactttagacaagcttaatataagcactgaaaatctagaagaaaaatcattagataaaaactctgaaggaggcaaataa

SEQ ID NO: 1034 - DNA, 279 bp, Methanobrevibacter ruminantium
atgtatatagaaatcataggagttattacaattttaatggctttaagagcagtaataactaaaaacagagcagaaaagttactttacataaatgtaataggtttctgtgtatctgctatcattgcattatatattaaaactacatttggctttgtattagctgcagctttcttcatttcctctacaatcggttcaaatgcaattgcttatagcttaaaggatttggaagatgagataagctatgataaggatatggaagaaagggatgaagagaattaa

SEQ ID NO: 1035 - DNA, 501 bp, Methanobrevibacter ruminantium
atggatatgatcattggaataatattagctgcagttatctcttggattaattttgtagttgttgacacattcctaggcttgcctgaggctccaggagttaagggtgcagagactgttggctattcaatcaaggaaaggaaaggagatttggctggaggtttcttccaaggaaacattttatgttctccagatgcttcagcaggaaccttgatagcagcaataggagtctatgctttaggaattcaaggagggcttattgcagcattgcttgtctatattggaaacaggctatgtgcagatccaggatatgccggaacctgcggagcattgaccatgacactattgatattcattttctcatttgttggaatcgaagttgagatgttcatttgcggaatggtgattgcaatatttacaattcaaggaattcatcatcctacaagttccagattgcttggaaagattgctaagtcctttggcaggtatactaaatatgaataa

SEQ ID NO: 1036 - DNA, 279 bp, Methanobrevibacter ruminantium
gtggctatagtagttgcagtcattatcgcttttgccttaagattgccacttcttcccgaaaggccaatcaggttctcttggactactagcgcactgtttccaacccctatttttgctataggaatattggcaatattttattcattaaatgtttattggatttatgacggtctcatcttaagcgtgattgtcggattagcttccgctctctttgtaaagtatggatttgactacatattcccaaagcctcctcaaatcgaagacggggggaatgtctaa

SEQ ID NO: 1037 - DNA, 147 bp, Methanobrevibacter ruminantium
atggaaatcgatgaattaattacttacttaatcattattgcagttgttgcgattttaataaaaatattttcatggctcttgcctatctttgtaatattggctgtagcctatgtaatttatttatatattactgaaaacaatgcataa

SEQ ID NO: 1038 - DNA, 762 bp, Methanobrevibacter ruminantium
gtgaaaaaaataatagaaaagcattacggaatacatttaaatcctaatgattttcttcctattgaagagattaaatcattaatgcagctttattttttgctcataatactgcttatttacatatgcatcatgaacttcttttttaacaattttggaataagcggggaattgatctttatcaattcattaatagacattatcttatcagtatttctagtgacaatatattatgacggctctacaagaggcaagataattagcatattccttttgcctattgtatccatatcctatatcctctttggaggatcattaattagatattgggatttcatccgcatccctatactgctctatctggttgtgattttctataacaagtttatagattatacagaaagaaataaccttggaaaaacaattctaatcctattaagcattatctatacaggaattctcttaacaatagtcttagaaaaacaaaatcctatagatgcagtggcaatggttacaaatgcaattacaagcaatggatatgccgctttaggagacagcgaaggaggagtcttgactagcgtattcctagcttggggaggatatattatttcaggagtcgctacagccacattagctgcagatatcattcatagaaactctagaaagaaatttaggaatatggaaactaagatagacaatcttgagaataagattgataatctggaacggataattgttgaatctcaaaaggagaatgaagaataa

SEQ ID NO: 1039 - DNA, 1024 bp, Methanobrevibacter ruminantium
atgtcatttttaacattaatattaaaaaatccttttaggagcaaaagccgagccatacttgcaatcatagggattggaatcggtatagccacaatcatcgcattgggagcaattaccgacggaatgattgcaagtgcagatgacacactgcatgccggaggatgtgattttacagtaagcggaaagatagagagcacatcatcacaaatggctacattcggtacaagcaccattgatgaggattatatagataagatagccaatgtaacgggtgtaaaagatgctataggaatgtatatgaccgtccttatgacaacaaattccccatattttgctgttgtaggattggatccagaagactatcaggtttccgacttgacaattacagaaggacggatgtataaaaacgacactaacgagatagtgattggaaagattgcatctgaaaatgaagagaagggagttggagacacaatcacacttgatgacaagaaattcaagattgtgggaatctatgagtcaggtaacacccttcaggaccaaggaggatttacagccattaaaaactcccaaaaactctcaaaggatgaaggcaagatcagttccatctatatcaaggtaaatgatggagaggatgttgataaggtcagagatagaatcaccgacaaatatggagacaatctgacaacaataagctcattatccgacttggaaatgactaagaacatgatagacatgttgaacggagcaagcttagccatatccctcttggcaatcataattggagctgtcggaatcataaacactatgcttacaagtgtatttgaaaggacaagggagcttggtgtcttaaaggcagttggatggtctgacgaaaagattctattaatgattgtaggtgaatcaatagtcattacaattgttgccggcataatcgggtccattgtaggagtcattggagtggaactccttgcagcgtctaagataatgcagcttctaaaccctgtatattcagttgacatat

SEQ ID NO: 1040 - DNA, 1024 bp, Methanobrevibacter ruminantium
atgcaaaccaataaaaacatcgaatcaatcataggagaccctaaaaaggccataaatagattgacctatcccacaatcctttccatgcttttaatgtttgcaaataacttaatagacagcatgtgggttagcggactgggagctgaacctcttgcagctctaggattcatgtctccattgtatctggtgattattggctttggaagtggagttggagcaggcgcaaattcacttatatcccgtttgattggtgctaagcgttatgatgagtctaacaatgctgcaatccatagtattataatagctcttatcgtttcaatcatcatttccattattggaatgttcttcttagatgacttgcttgttctttttggagcggggtctgttttggattatgcaatggactatggtatgataatctttctatcaagcatcataatactatttccagccattgtttcaagtcttttcagggcagaaggggacattagaagggccacagtgcctttagtggttaatgcaatcctaaacattatctttgatcctattttcatttatatttttaattggggagtcaaaggggctgctatcgctacagtattgtccacacttgtcaatctgcttatgatgctatattggtatctggtaaagagggatacattcataaaattgagtttggagtactttcatagcaaaatggaaatttataaggagattctttttgtaagcatccctgcaagcttggaagagcttatctattctattgtagctatctgctttaattatctaatcatgattactgcaggaaccatggaagttgctgttttcactgtggtgtggcgatttgtgtcaatcgcttttcttccatgcatttccattggaatctctacaataacagttgcaggcatagcttacggggctagaaactatgagaattttaagacaacaatcaattattcgactttcctaagctttacaattacattgataatatgcataatattctttgtatttgcctatccga

SEQ ID NO: 1041 - DNA, 1024 bp, Methanobrevibacter ruminantium
atgtttggtaaagataaaaaagagaactctaatgaaaaagtgttgtatgaagggcaaccaaatttgatagtttattcaaagagcatattcattgcagtgattttacttggatttctatttttcctctattcaactggaattcaatatattggaaacatgcaagtctatatgatagaatcaaccaaattgccattgactcgctattttgcaattgcagtctttgttataataatggttgtaatcctatatatcataataaaattcctttcttggacttcaataaagtatacaattactgaaagcagagttatcgttgaaaagggcattatatttaataagaagaattacatgccttttaacactattcaggatgtaagtcgttctcaaagcattttaggaaaagcattctcagtaggcacaattaccttatacagtgcctatgacggcaaggacatgtcattaaaggatgtctcaaaccctaaaaagattgaagatttaatttttgagaatatgaggacaactcatctaaggtcacataacttatatgacgattcctatggcaatccatataataacagttataataaccataacaaccattggggatatgacaattatggtgattcctatcaaaatagggactttaagccaataaggcctaactctgatgaaaaggttcattataatcgtatggaagatcttgatgaccttgaattggttgatgtaaaggagagaaaacgaaatcttagagaaataaggcgaaaagctaagaattccagaggaaataattataataatcagccgattgatggtccgagtaacaattataatagaaattccaattatgaccctaactataacaggaactctaattataagcagaatcctaattataataatcgcaacaactatgatgattttggctatgatgattatgaatctggctataatcaaagatccaaaagagcccctcaaggcaataggggctattcaaaaaggaatgcaaatcaatacagagacgatt

SEQ ID NO: 1042 - DNA, 1024 bp, Methanobrevibacter ruminantium
atggcaacttttaaaggatttgcaatgaaaagactcaatgaaatcggttgggtagaaaaagaagtacctgaatgtggacctatggacgctattattaaaccaacttgtgtatctccatgtacttccgatattcacacagtatgggaaggtgcaatcggtgacagaagagacatgatcttaggtcacgaagctgttggtgaagtagttgaagtaggtagcatggtcaaaaaattcaaacctggcgaccgtgtaattgttccagctatcacccctgactgggacgatgaagcagctcaaagaggattcccttcacaaacaaccgaacctctcggtggttggaagttctccaacttcaaagacggggtattcggtgaaagattccacgtaaacatggctgacgcaaacttaaccttcatccctgacggattatccgacgaaggtgcatgtatgttaaccgacatgtggtccactggtatgatgggatccgaaaacgctaacattccattaggtggaactgtacttgttattggtattggtgcagtaggtctttctgctattgctggtgctaaatgtttaggtgcaggtagattattcgctgcaggtacccgtcctatttctgtcgaagttgctaaaaaatacggtgcaaccgacataatcaactacaaaaacggacctatcgatgaacaagtaagagaacttaccgatggtgcaggtgtagactctgtagttattgcaggtggtaacttagaaaacacatgggctgaagcaattaaatctgcaaaagcaggaggaactgtatccaatgtaaactacttaagtggtgctgacaatgtattaatcccacgtgtagaatggggttgcggtatgtcaaacatcaacattacaaacggattatgtcctggtggagcagtaagaatggaaagacttgctgatcttgcattatgcggcagacaagaccctgaattattagttacccacaaattcaaaggtcttgaaaaaatcgaagatgcattgctcttgatga

SEQ ID NO: 1043 - DNA, 738 bp, Methanobrevibacter ruminantium
ttgctaaagcagatcattaggaaaaattttacaagcaaatataaggattctgttttaggcatactttggagttttttcaatcctttaatcacaatggccctattgacagcgattttttcatcagtctttgcaagaaacattgaaaatttccctgtttacttcttaacaggccgttgcgttattgattttttcaatagcggaactaaaatagctatgacctcacttaaaaagaacagcggtattttaaataagatatttgttccaagatatgtatttgcattgggaggaatcttttctgaattcattaactttttaatgagtatgatagtgcttattgtgattatgattgtaactagggcgcctttccatttatatgctattttttcagtcattccaatagccatcctattcatactgattttaggagttggactgacactttccatactctgtaccaaatttacagacattgaatatttatataagatatttaccagcttattagtatatgcttgtgcgatattttatccaatagacattgttccacaacctatcagacagtatatggaattaaatccgatttatggtattatagctcaattcagagagtttgtcatgtatggaagattcccatcaacaaagttgatgctgataacctttttaacttcaatagtaatctttataattggagtaatcatatttaagaaataccaaaacagaattacattagagttataa

SEQ ID NO: 1044 - DNA, 831 bp, Methanobrevibacter ruminantium
atgggatatttaacagatttatttaaggaagctttggtttatcctctcagcaatatagttacattaattattcttggagtattgctaacaataagcaagtttccaaatgttctatcaagttttggagtagatgtcgattttcagttaataattatctttgcattgatttcttttgtagtttcattattcatggacggctattcattggctgtaattaaggatgcagttgacttcaatgtatcaatgcctgcttttgacattatgaaaaatttcattgacggcgttaaggtatgggtattgaaaatactttactatattattcctacaataattacaatttttgttgctttattgactggaggagttgacgcaatacttaatatctttaggtttatcggtgaaaatcaggagcttttatccaatctaaatacaccagcagaattgataaatgcaattcctcaggaatatattgcaactttccttactagcttattcattactgcaattgttgcaattattttatacattatatttggtcttctttacaacattggcctttgcagattagctaaatatgacagcttcaatgaaggaataaacttcaaggcaatcatcaacgacattaaggcaatcggtttgggaacttatattctatggtatattatattgttccttatcatatttgccatatccattgttatgggcttgattgcagctattccatatattggaattatattgcttaatttgctttttgctccatttattttcttgttggtaaacaggtcacttggtttattgtatactaaagcagaaggatataatggatag

SEQ ID NO: 1045 - DNA, 702 bp, Methanobrevibacter ruminantium
atggaagactttaaatattacaagaataagattaaagaggagattaaactagcatttgctcataataaatactttttaatcgtttctgctcttattttcattattcctatgtttgtaggatatttctattcagatcagataactccatacattcagcctatggttgatacctttgaggaaaacattagaaatggaactgtgactttatcaacaaagtccctatttgcaaataatgttgaagtggctataattctatatgcattatctgcccttggggctattttaggaattgtcgttttagcaaacaatggattatttattggattttatggtgcaaactttgaattgacacgctatgttcttttaactcttcctcatggaatatttgagatttcagcaatcattattgcaacaacaggaggatttgtgattctatcatttgtgctgaacttcttgtataatgtgatatatcctgattactcctatactgatatatttgatccttactttagcgatgctaaaataactgtgggacaaagatttaaatcctcttttaaaaagcatggtcatagaattaaggaatcttttatattgctttgcgtatctgtaattcttcttataattgcagcattcattgaggcaaatattaccattccttttgcatattggatttgctccttgtttgggataagcctgatttaa

SEQ ID NO: 1046 - DNA, 1024 bp, Methanobrevibacter ruminantium
atggctaagagaaattttagtgaaagcttaggcaagatagtcacacttttaaaaaaggattttactgatgtatttaccaaaaatccagttgtgcctattgtattgcttgctattataattttaccttctttatatgctcttataaacatccaagcatgttgggatccatacgataatacaggaaatattgagattgcagttgcaaacttggataatggaaccacttttgaaggagaatcattaaatgttggtaatgagatagaggatgagctgaagggaaatgatgatttctattgggtctttgtaaatgaaacggaactgcgagagggggttaaaaatggaacctattattccggaataatcattccaaagaatttcagtaaaagcattaagtcaatcactactgatgaccctcattctgctgaattggaatatattgtcaatagaaaatccaatcctatggcatctaagttaagcgattccgctgcaaaggcggtctataataagatcaatgctaagattgtacagtttattaatgtggtggcctattcaaagttaggcgagcttcagtctgcattgtctcaaggtgcaggtcagatgtcatctggtgctgtccaattgtcttccggatccgctcaggtcaattctggcgcttctcaagtgaagtcaggctcaaatcaggtgaaatccgctgcaaatcaagttcaatcaggtggtgctgaagttcaatcaggcagtgaggagataaagtcccatgcatctgaggtcaagtcaggggcaaatcaggtctctcaaggctcttcccagatacaaagttcatcccagcagattcaagcaggttcctctcaagtgcaaagttctgctaagcagttggattcctctgttgatgttgacaaattgccgagtgatgacttgaagcatgttgtaaacagttccaagcaattggctaatgcaagttccaatctggcgggatcttcaagtcaactggcaaacggttctgtccagcttgcaaatggctctgtcc

SEQ ID NO: 1047 - DNA, 201 bp, Methanobrevibacter ruminantium; identical to SEQ ID NO: 942

SEQ ID NO: 1048 - DNA, 1024 bp, Methanobrevibacter ruminantium; identical to SEQ ID NO: 944

SEQ ID NO: 1049 - DNA, 828 bp, Methanobrevibacter ruminantium
atgaccataagtcccaagagaatattatatttagatgaagttcgctcacttgcaatcatgctcgtagtcattgggcatttggcaaggctgttttcatataactacaatagttggctgttctgcagcggagtattttccctaactcgtataggcgttcctctcttttttacagtaagcggatctcttcttttaactagaaaatatgaggtaaaaaagtttttagaaaagcgattcaaacgtgtatgtctgcctttcttctcttggataataatatatatagttgccggagtgctgatttggcattatgaccttacattcgaatatgtggtaaacactgcatttggtgttggagactattctgcactgttctggtttatttggtcacttattggagtttatctattaataccagtcatcagcagctttatacgtgaagagggaaattggggagcagaatatctgattttaattacaataatactgtccctattatacacattcggattctttgactatcctcaaatgaaatataactttagagtcatctttaacttcttcccagttctcggatacttcattatggggtcttacattcacaataagaagtttaagtattcagataagaagatgtttgctatcggatgcgtcttgtttatagtcggaatctgcggacactttgcaaaaatctatcttaagggtcttggaggactttcccttgcaccgatagacttctttgacatatgtgtaataatggaaacaatagggctattcattgcatttaagtatgcaagcaccaaatgggataaaaggaaagatgcaagaaattga

SEQ ID NO: 1050 - DNA, 258 bp, Methanobrevibacter ruminantium
atgcaagaaattgaatttagggaaaccaaattaggtgaagtgattgttctatttgcatcatgcagctttggaatctatttctcacattatattcttatgagatatattatgtataatggatttttagctccaataagaaaaacacatgcactgttttggcttcctgtaagctcaataatcataataggattaagttggcttttaatatacgtaatgagcaagattccatatgtaagaatagctagtggggttaaatag

SEQ ID NO: 1051 - DNA, 720 bp, Methanobrevibacter ruminantium
atggaaatcggagaaattattactgattctttaaagtatcctattaataacattaaagctttaataatttacatagtcctcggtatcgttgcaggtcttgtactcgtattaaccggcgttggcgtcggagcaggtgcaatagcaaatagcgcagcagccactggaattgttggaattattggaattattatattcttccttatatacttattaatcttaggatacgaattagatgttataaactttggtattgaaagaagagatgacgctcctgaaatcgacttcgctagacaaataactaatggtattaaatggtacattacttgcttcatttacatgttaatcccaactatcattatgataattttatcatacctcaatcaaactttaggtttaattgtaggaataatattatttatcatagcagcattcgctttattaatggctcaatgcagattagctcacacagacagcttaggtgaagcattaaatattccagaagcaattaaagatattacaaaagtgggaattataaaaataatagcagtattccttattttagttatcctaggccttgtcgtatcatttattttaggtttatttagtgtattaggcgatgtaggcacatatattggagctattttatctggtattttcacaatctacctagcctttgtagtcttcagagctagtggattattatactcagatgcagtttaa

SEQ ID NO: 1052 - DNA, 789 bp, Methanobrevibacter ruminantium
atggcgcaaatcaaatgcccagactgtggcaaagaacaagaagatacaaataaattctgtaaaaattgtggagctaatctatcaaatgtaaaagcagaagaagtaaaattagacctagacgctgctccaactgaagagaaaatagacttaaacactgctccaactgaagaaaaattagatacagatgcttctgaagttaaagaaactcctaaagctcctgtggaaaataaaaagatatgcagcaaatgtggacatgaattgaataatgaaaagttctgtccaagatgcggacaatccacagcatccatagttccatatgaagccaagactgaaagccaaggtgaaaataatgacaaaacctgtccatcctgtggaactaaagtaactacagaaaagttctgtccaaattgcggaagtaaaatagaagagaaaaaaccagttcaaacacaaaacgctccacagaaatattgtagaaattgtggaaatccgattgatcctaaagctgaaatatgtccaaaatgtggcgtaagacaattgactgttgttaaaaaagaacctttattctctcttattctatcacttatattcccaggccttgggcaattctataataatcaaactcataaaggaatctttttaattattggagcaatcgtatccatcgttttaacaatttttgtaattggagtcttattatacatgcttgtatggctttacggtatgtacgatgcatatagcactacaattgctttaaataatggagagtatgttgaagataaactcttctaa

SEQ ID NO: 1053 - DNA, 1024 bp, Methanobrevibacter ruminantium
atgcaaagaaagacattatcacgttttgatgaaattgtaaaaattcttaggaaatatgatatggataaggttttaggccaaaccacccgtaataggataagcccatttagaagtggatcagaaaataaagaattattaaaggaagactttccagaaagattaagattgacattgcaagagcttggaaccacatttatcaaatttggccaattgttaagcacaaggcctgatttggttggagagagaatcagcgaagaactttcacagctccatgatgataatcctcctattgactttgaggaaattaaggtaattatcgaagaggatcttggaggaaatctaaaagatttttttacagagttttccgatacagcccttgctacagcttcaatcgctcaagtccatgaggctaaactgcatagtggcgaaagggtagcggttaaggtacaaaaaaccaatgttcaagaaatcgttgaaactgacttgaatataatgaaattccttgctaatgaatcagacagattcaataccacctttaagcatcttaatcttcccgctgtcgttaaggaatttgacaggtccattcataaggaaatggattttgacaatgaactgatgaacatcagacatttaagagacaatttcattcataatgataagatcattgttccaactatttatccagactattcctctgaaagagtcttgactatggaatatgttgatggggtcaaattatctgaagttattgcaggggatgatccaaaatataataagatactcattgcagataggatggttcgtgcttattttaaacaaattttccttgacggatttttccatgcagaccctcatcctggaaatattttcattacagatgacaattccatatgtttcattgattttggaatgatgggagttcttgatgaaaacttcagacaagatttggctgaattgatgatttgtttctcaaatcgtgacattgatgggctaatcaatcagttaatttatatgaatattctaa

SEQ ID NO: 1054 - DNA, 966 bp, Methanobrevibacter ruminantium
atgaagcatagattaaatttagataataaagacccaaattatattttgttgaaagaaatatttaaaattatggattctagaaaatccaaaagtatattagcatcctatggatttaaaaacttaaatagaacaatatttacttttaaaattatatttataagtatgttctttggaattgacattccattcattttaaacgagcttaaatccaaaaaagaacttcgcaaatactttaatatttctgaagttttgactgcagatcaagtttataaaattttttcagaaataaactctgaaaaacttataaaatgtttaaacagaatcttaaactcaagaaatatggtcaaaaggagaggaaaaaagactttcattgtcgatgcgactccagtggacttggatatcaatttccgcagaaataaaaagagcaaagaacatctcagaaaattgaatctcaaatggagttattcttcctctaaaggctattatattggatttaaagcgactgttgtgatggattacgattctatgaatcctgtttgcattttaatccattctggagctccaaatgatgcaggactttttgaagagattttagaaaaccttcaaaaaagacgaataatcagaaaaggagatacattaatctttgataaaggatattacggctataaaaactaccaaataggaattggcaagtataaaatcgttcctttcatttttccgaaagaaaaattcaacagaacaagacttgatgatattttaacctatccattagccgtatttaacaaaacaaagaaaataatggaagaaaaaagattatacaacaaattaaaaaaggaattattagaaaaattagattcatgggagaaatttaaaccaataaggggcaaaatcgaagatttttttcaaattattgaaacaaggcttgaatatgagagaaatccacaaatatactccaaaatcagttga

SEQ ID NO: 1055 - DNA, 576 bp, Methanobrevibacter ruminantium
atggcattagaacttatgaatttattgatttccatcttaggagctgtttattttatgctacctgcttatgtggctaacttaagtggtcttgcttttggagggggaactccaattgatggcggagcgaattaccgagatgggaatagaataattggaaacggagtaacatggaaaggttgcattaatggaaccattattggaactcttgttggtgtggttttaggcatagtcggaatgtactatggtgatttaagcactttaactggaggagtcatcgatctccatgtttatggaagcctattctctggtcttatattaggattcttaatggcattcggcgctttattcggtgatgcagttggaagtttcataaaaaggagaatgaatcttcaaagtggccagcctgctccgataatggatcaattagattttgttcttggagcccttatatttagccttttagttgttagaataagttggagcttttttattataatttgtctgcttagtattttacttcatttaagtagtaatactatagcatatttgcttggaattaaggatgtttggtattaa

SEQ ID NO: 1056 - DNA, 642 bp, Methanobrevibacter ruminantium
atgtttgaatttacaaaaaacgaattaagagatttagtgattgcatttatcgtgctttcaattgcttttgcaatagcaaatgtcaaattcgatttgcatgcattcatttcaattctacctattgtaatgtttggagtaggagtgggattcctattgcatgagcttggacacaaatatgtggcaaataaatacggttacaaagcggaatttaaattatggcctataggattattaattgcacttattacatcacttataggatgggtatttgcactgcctggtgaagccaagattacagcagagaatattgatgaagagaccactggaaagattgcaatcgctggaccgatggctaatatagggcttggattgctatttatagtaatagcagctataacatatccattaaaaagctcatttacactttttgaattaatttacctagtcagcactgttggcttctctgtaaacgcatttttagctacatttaacatattgcctttctatacattggatggaactaaagtgatgaagtggagtgttaaagcatttattgttgcattcgcaatagctgcaatcatgatgttatcatctatgtttataggggctgaaaatatgattttaatgcttataggaagttaa

SEQ ID NO: 1057 - DNA, 1024 bp, Methanobrevibacter ruminantium
ttgggccttattacaacaggtatggaacagtccgttcaaacaacaatgaacgaaggtgctgcagagataactgtaaccaatataacctcaattggtgcagggactattgattccagtctggtggatgagttaaagaacataactaatgtttcacggactgcggggattttgtctgccacagatcaaaactttgttgatatggcctcatcgaacgatatgtcttctatggaatcctctacaaggctttatggaataaatcgggcagaccttgaccttgaaggaataaaagacataaatggaagcttttttgaagaaggcactaagcaggccataattggcaagcaatatgctcaaatgaataatatgtctattggagataatatttccgctttaggagaggaatttgaaattgtaggggtttttgaaaccggtggagtccttgcagatagtggagtttatgtttccttagaaaccttggatgaggtaacaggtgctgaaggaaaggtaaatcaggttatagtcaagacagatgaaggagtaaacgacactgttgtggcagatgcgatagaggataaatatgagaatctgacaacaataaccagcgaagagatgtctcagatgctggataatgttatcggtattcttgatgctgtttccgttgctgtttccgctcttgcaattattgtaggtgcaataggaatcgtaaatacaatggtcatgtctgtttatgagagaactaaggaaataggtgttttaaagtctgtaggatggaaaagcagaaagattctaaagatgattattggagaaaccttggttttaacaatcctttcaggtattgtaggctcagcattcggtattctcattgcagaggtcggtgtcaggctgatgggagatacagattttgctttgggatacagtccaagcactttcatcatggcatttggaataaccattgttgttggattgattggaggaatttatcctgcttataaggcaagtaaattagctcctacagaagcattga

SEQ ID NO: 1058 - DNA, 855 bp, Methanobrevibacter ruminantium
atgattaagaagaaaactaatgataaggagcaatggtttatataccgtgcaaatcttaggacaaagacacttgtaattattggacttgcagcattgattatcataagcattttcgtatgcggatatttcataagggacatccctacaaatttcgcttcagctaatcagatgccttcccttgaacaccttttcggtacagattggatgggaagggacatgttccaaagaaccattgccggtcttggattaagcattatggtaggtttcatcgcatcagttctcagtaccatcatttcaattgtcttaggattgttctcaagctttaataagtttgcagatgaggctgttgctggaatcattgaccttttcggttccattccacacattcttctaatcattatcgtttcaataatgtttggtggaggagtatggggtgtaatcatgggcgtaggtcttacacactggacacctcttgcaagggttctaaggtctgaagtcaaggagattaagaccaaggaatacattgcattatctgaaaatcttggaaggaataaggtttggatagctataaagcacattttcccattgattatctctcaaataattgtaggagtaatcctaatgttccctcatgcaatcatgcacgaggcagcaatcactttcttaggattcggtctgccacctcatgagcctgcaattggagttatattagctgaatcaatgcactatctttctgctggatactggtggttggcattctaccctggtctatccttgctgatagttgtattgctatttgatcttattggagagaatgttgaaaagctcctcaatcctgaaacagcacaaagttaa

SEQ ID NO: 1059 - DNA, 990 bp, Methanobrevibacter ruminantium
atgaataaacaaaaaatagcaaaatattttggttggaaattagtacgatttgtcgtattaatgattgcagttgcaatatttagttttgtattattagatttatcccctattgacccagttaatgcttatttaaaaggtgctgcagtaactgaagctcaaagagcaattttacagcaatactttggtaccaatgttccattgcctgagaagattttccattggcttatggatttgcttcaaggaaatctgggaacttccttaatctaccgtagaccagttatggatgttattattgacaaattcatggcttctcttgcattgatgacaatatcctggattttaagcggtatcatcggttttgctttaggagttgtagccggtaaaaacaaaggttcctggattgataaggcagtgaaggtctactgttatgccatccaatccgctccatccttttgggtgggtatgcttatatcgatggtattctctgtttatctgggatggttcccaataggattcggagttcctattggagtaaggagtacggatgcaacctttattgagtgggcaaccaggctggttcttcctacgctgacattaagccttgtaggtcttgctcctattgcaatgtatacacgaaatgaattggttcaggtcctatcctctgactatgtattgtttgcaaagtccagaggggaaaagggctgggcactgataaaggatcatggtttaagaaatattatgcttccggcaatcacacttcaattcttatcattcagtgagctcttcggaggggctgtcatggtggaacaggtattctcataccctggaataggacagactgcagttgcagcgggtcttcaaaacgacgttccactatttttaggaattgtggtcataagtgcaatatttgtatttgtaggtaacttgcttgcagatatttcttattacttcatagatccaagaattaaggagaatgagttcaatgattaa

SEQ ID NO: 1060 - DNA, 708 bp, Methanobrevibacter ruminantium
atggaatttttaaaattaaaaagatcaaaaatatttttattaagcgttcttatggctgtgcttccagcccttctgatgtacatagcaacatttgcttttgatgaagtccaggcctttgacgctctatttaccaatgtaaacatgtatatgtctgtattgtttgctgttcttatctttgcaatcattatggcatatctctttggaagggaatacaatgaacataccttaaagatgatgcttaccattccaatttcaaggggaaagttcctgctgtcttgttttctcttgttccttctttggcttttggttctgtcggttctttcctgcctctcctctctgatttttggttttgctgcgggactaagcggatttactgtaaacttgctaattaacagctttgcacagcttctatttgcaaatctattgctctttttgacattctctccgtttgtatttatttcattgtttgttacaaatatggtgcctgctatggttggcggagctagtctaactcttgttaatatgcttgtttacggacaaacctgggctccatatgtcccttgggtatgtccttatcttattgcatctggagagatagcagaatatggaataaatatgctattgccttatggattggtttttgctactttcatagttggaatagtcatttcttatctttactttactaaaaaggacgttcctctttag

SEQ ID NO: 1061 - DNA, 1024 bp, Methanobrevibacter ruminantium
atggaaaatcataaagccttaattgccatacctattatacttgcacttttatcacttgctcttatctcctttaatggaatagaacaaggagttgaacttaaaggaggatcacttgctgaactgcaactgacaggttcaacaagcgtaaatgaccttgaaagtcaattaactaaagaattgaatacaaacaacataaaagtgacaagcaatggcgaaaataaggttactgtagaactggaaaataatgttaattcaagtacattttcaaaggccatagatggaaaggcaaaggtgatcagctataatgagataggtcctgttttatctgaagaggcaatgggacaaatatatatcgctatgctatttgcatttttatttatggcagttactgtttttattgtatttagagagcctgtaccttcagtagctattatcctagcagcattatgtgatatactcattgctcttggaggtatgtccattcttcacatacccttgtcaattgcatctgtaggtgcattattaatgcttattgggtacagtgtggatacagatattcttcttactacaagacttcttaaaagaagggaaggaactgttgatgaaagagctagaaacgctatgcacacaggtttgaccatgtcctgtgcagctatcgctgcaatgggaattctttacatagtcactgtaattatcatgcctgaagcaactaccttaagcaatatttcagcagttctggttattggattaattggagatattctttcaacctggcttatgaaccttggaatcttgaagacttatattgattggagacagtctaaaaagcaagataagtttaatatagatgctcctaagtctaatgagtctaaatccaaatctaaagaagaagatggcaagtctgaatccaaatcatttaaggacagatttaaaaggtccaaggatgatgattctaaagattctgaatctgaagactcttctaaagattctgaatctaaagactcttccaatgacatagacagtt

SEQ ID NO: 1062 - DNA, 1024 bp, Methanobrevibacter ruminantium
atggctagtaatttatccaaattcttcaaggatagacaagtaatcatcctaattatttgcctcataatcagtatcataagcataagtttccttggagtagaacaaggacttgacctaaagggcggttcctccatccaattgcaattggaacatcctgtaaacgactctacaatgaaagtggtcacctctgtactggacaaaaggcttaacttatatggtgtaaccgatgtaaaggtccgttcaagcggagaccagatggtcatagttgagatggctggaaagagccccgaagaggtggagcggctgattggtaacccaggtatttttgaagcaaaaatagacaataagacagttctagtaggcagtgacgttgcaactgtagacgctcctgttgttggagagtctggagaatggcaagttccatttacattaactacagaaggagctaagaaatttgcagagcttgcaaagggaaaaggcggacatgaagtggtaatgtatcttgacggaaagcagatagatgaccaccctcctgcattggctgaagagcttgcaagcggagaggctgtaactgaagttcaggttacaggtggtgccgaagatgttgaaacagcaaaagcagagtcaaatgaagtattcactgtattaaagacaggttcacttccggtaaagattcacactgtaggttccaatacagtttccccagagttaggtcagcagtttgcacaaggagcattgattgcaggtcttcttgcaatccttggtatttcagcagttgtatatatcagatatagaagagccttcctagctatccctatactcattacaacattatctgagataatcattatcctaggggtcgcttcaataatccattggaacatagaccttgcagcgattgcaggtttgattgcatctgtaggtactggggtagacgaccagatcatcattacggatgaggtgctgcaccacgacgatgaaaacaccaggcatagaagaacaagaactcaaatgaatgtgaaga

SEQ ID NO: 1063 - DNA, 429 bp, Methanobrevibacter ruminantium
atgtgggagatggtttggcctattttgcttgtcattttatctaatacgatttataatatttgtaccaagtcaactccagggaatgtgaatgcctttggaacattgatgataacttatataactgcagctattttaactgctatcatctttgtatttctggtaaagcctgagaatgttatggtggaactttctcatgttaattggacatctgttgtgcttggaatagctattgtgggattggagcttgcttatatttttgcattccgtgccggttggaaggtcagttctgcttcaattgttgcaaatattggacttgccattgttcttgtattcgttggggcgattctttatggtgagaatataacacttaagcagcttggcggcatatttatttgtgctgttggattatttttgattaatatgggttaa

SEQ ID NO: 1064 - DNA, 1024 bp, Methanobrevibacter ruminantium
ttgcaagaggcaaacgaagacatagatttaatcgtaaaccatccaaagcaggcaattaacaagcttgcacttccaatcattttcagcaacttcttcatggttttaaacaatatcatagatggaatatgggttgctggattaggatccaattccttggcagcagttggctttgtaactccattgttctttgccatggtcggttttgcaaacggattgggagcaggtgccaacagcctaatatcaaggtgtatcggtgctgaaaactatcagggggctggaaacagcgccatccattcgatgatgttaagcataattgtcacaatctttgcaacaatcgtccttttggtgtttttaaatcctctccttatgctgatgggtgccggtgaaatcatagaggaaacttcaaattatggttatataatccttgttggagcatattctatctttttacctgcaatgatggctgcaatattccgttctgaaggggaaatcaatagggcttcctatcctttgatgcttaatgcaataatcaatatgatcttagatcctatctttatatatgtccttggatggggagtcaagggtgctgcatttgcaactgttcttgctggaacctttgcaacacttccaatggtctattggatgtttatcaagcaggacagtttcctaaaaatcaagctaagcgaatataagaccaatctaaagatttataaggacattcttgtagtgggaattccagcaagcattgagcagtttataatctcttttgtgtctatccttatgaattattggctaaccctcttggctggaaccctggctgttgcagcatatactgcaacatggagattggtgtcaattggagtctctccaatcattggtattggagttgcagcacttaccgttggcggtgctgcctatggggcaaagaatctaaagaattttaagacagctctaaattacagtgcgattctaggaattatttcatcaataatcatatgttcaattttctttgtatttgcagagc

SEQ ID NO: 1065 - DNA, 726 bp, Methanobrevibacter ruminantium
atgtttataggtcttttggctccggctattgtgtctacagttttcattatgctgtcaggctcagacttgcttaagaaggactttaagaataaaatgatcggcttttataaggtaaaatggctgaatgtgatttgggctgtgattgtatttgcgattgtaatagtctgttccattttgctttcacttctttttggacagccaattgaccagttttcctttactgaaagcttttcctttacaggtgttggaattgctggagcatttatcacaattacacttgcttctataattgaggaagtgggatggaaaggatactgtgaggattcaatcggtaactatatgaactggttttgggaatccatgatttttggagtgctatggtctttctggcattttcctttaatctttatttcaggaacctatcaggcaggacttatggtaaatcctctttatgtgattaacttttttgtcagcggaatccctatgggatttgtcattacttgggtctatcttgaaagtgaccgttcaatattggcttgcatgatattccatttcttcgttaatttcatgcaggagaaaatagcgttgactccagagacaaagtgcctggagacaatagtgataacagtggttgcaattcttatagtcatggctaaaaaggatatgttctttgaaacccgtcatgttggaagactgcttgaatacaatagcagccagcagcaataa

SEQ ID NO: 1066 - DNA, 1024 bp, Methanobrevibacter ruminantium
atggaagagtccaaaactagatttgaaggagttgaatcaatcttaggagaccctaagaaagccatatggaaattatcaattccattaataatttcactatttatcacaagcctctatagtgtcatagatgccgtttgggtgtcctctcttggtgccgatgcattggctggtgttggctttgtaagtccaatattcattgccctaatgggaattgggaatggtttgggagcaggagcaacctctgcaatatccaaatacattggagagggggataagaaaaagtcagacaatggtgcagttcatgcaatagtaataaccgttattgtatcaatatttactactcttcttttccttatattcctaagggatattcttctttcaatgggggcatcaaatactatagattatgcaatggattatggagtcattctagtttcaggctctatattggttattctatccaattcattatacggggtccttagaggtgagggagatggaaatagaactatgtatgcaatgctatttgcctctatcttaaatatgattctagatcctatatttatttattatttgggcttaggagttaagggagcagctattgcaactctcatttcccttttgtttgtaaaccttctcttgttttattggttttacattaaaaaggacacttatttaaggccttttttaagcaattataggtttgataaggatataacagtagacatcttaaaggtaggttttccagcaagcttggagcttgttaacaatgccctctttgcagcacttttttcccttcttttaactgttgtcgcatcaacagatgctgttgcagtttattctacaggatggagggttgttacaattgcaacaactcctatgcttgctgtaggaactgctttgatttcagtggtagctgccaattatggggctagaagatatgaggacattttacttgcccataggtattcaatgaagattgcggttctatttggctttattgcagcgatagttgtctatgtat

SEQ ID NO: 1067 - DNA, 1024 bp, Methanobrevibacter ruminantium
gtggctggtttaaatctgattgatagtgtaatgtattaccctattctaattatcgttatggcaattgcaggactctactttacttttaaaacaagaggagtccagataagattatttttagagtccataagaatccttacggagcctccggatgaggaaggcagcatatcttcccttcaggcaatgcttgtctccacagcttcaagggtaggaacaggcaatatcataggggtctccactgcattatgtctgggaggtcccggcgcatgcttctggatgtgggtgatgtgtatcatcggagcatcatctgcattcatggaaagtacacttgctcagatttataaaagaaaggacaaggagggggtcttctatggaggtcctgcatattatatagagcatggtcttcataagcataaattggctctgctcttttgcgtatttctccttgctacatatgccgtaggattcaatatgctttgctcctttaaccttcagtcaacattcatggaatatccgttctatcatccaagcataactccgattatcataggtgccgtgcttgccattatcacctgctactgcttacttggagggggaaaaaggattgtcagtgtcacaagcacacttgttccggttatgggagtttcctatgtcatcatatgtttgattgtgattcttttcaacattcaaaacgtgccagttatgtttcttttaatctttagggatgcatttgatttccagtccatccttggaggggttgcaggatcatgtatggtttatgggataaaaagaggattgtactcaaatgaggcaggtgtaggttcagcccctaacgcttcagcttctgcagatgtatcccaccctgcaaaacagggattggctcagacactatctgtatatattgacacccttcttctttgtacagcctctgcattgatgtgcctgtccactggagtggtaagggatgcggcggtttccggtgctccatatgtccaaaacgccatttcatctgtctttggatgga

SEQ ID NO: 1068 - DNA, 1024 bp, Methanobrevibacter ruminantium
atgaatgtttttagaagttttatagatattctaagcgataggacagttaatgaaagaggatatttcttctcaaataaggcactctttgccttatttcttcctctgcttgttgaacaagccttagaattttgcgtaggtcttgccgactcaatgatggttgcctcccttggggaggtagcgatttcaggggtgtccttagttgactttttagttcagctgcttatatttagcttttcggctcttgctacagggggagctgttattgctggccagtaccttggaaacgatgagccagagaaggcatgtgacgcttcaaaccagctggtttggtttacaaccattcttgcagtaataatggctgttcttgtcttgatcttcaggccatttttaatcaatctcttctttggtcagatagagccggatgtctttaacacttcaagcatttatctaagctatatggctatttcaattccattcattgccatctacaactctggagcagcaatatttcgtacaatgaacaaggcaaaccttcctatgcagataatgtttgtctgtgacattttaaatgtcattggaaatgccatactcctatttgtctttggatttggggttgaaggggttgccattccaactgttcttgcaagagcattggctgcagtcataatgatctactttgtccttcaggaaaggtatgaaatacatatcagaaagacacttaggcataagtttgactgggtcttgcttcgaaaggtcttgaatgtgggaattccttatggggttgaaaacggcgtgttccagcttggaaggattcttatcttaagccttgtatctacattcggaacaatagccattgctgcaaactctgtaggatatgcaattgggatattttcagttcttccaggatttgcaataaaccttgggctgactgccgtcatttcacgctgtgttggtcataatgactatgagcaggccaagttctataataagaagatacttataataacctttttatctcatttgg

SEQ ID NO: 1069 - DNA, 960 bp, Methanobrevibacter ruminantium
atgagaacattggaatgggaagacaataaattaaagcttatagatcaaaccaaactgccagatgaattgacttatgtctactgcagcaattacaagcaagtgattacagcaattaaagatatgattgttcgtggagcccctgcaatcggtgtctctgctgcctttggtatggcacttgctcagcttgccggagaagacatggaaaaggttgcagttgagatgaagaatgcacgtcctactgcagttaacctgatgtgggcagttgatagggttatgaaagccgaaaacatgcttgatgaggcattagagatggctcgtgaggacattaacacaaaccttgcaattggagagtatggcgcagagcttattgatgacggagacactgtccttactcattgcaatgcaggagcacttgcctgcgttgattatggaactgcccttggagtcttccgctctgcattcaatcagggaaagaacattcaagtgatatgtgatgagacccgtccaagaggacagggagcaagcctaagcgtttgggaaatgcaacaggaaggaattcctgtaaaactcattccagatgttgcaagcggatatctcatgtcaataggaaaaatagataaggttgtaataggggcagacagggtggcccatgatggaatagcaaataagataggctcatttatggtggctcttgctgctaagaggtttgacattccgttttatgtagccgcaccaatcagcacatttgataaggaaatcagcatctttgatacagaaatagaagaaagagatcctaacgaagtcatttattatggaggagcaagaatctgcccggaaggaactgaagtaattaaccctgcatttgatatagttccaaaggaccttataacaggggtcattacagaaaaaggagttttcgatttgaataatttagaaaaagactttaaagagcttttctaa

SEQ ID NO: 1070 - DNA, 654 bp, Methanobrevibacter ruminantium
atgttattaagtaaaattttagaagaattattatggggtatgggaacctccattgaaatattccttcttacattgctgttttccattccacttggtttggcagtggctgctggaagaatgagcagcttcaagccacttcaatggtttatgaaggcttatatttctatcatgagaggaactccattgatgctgcagctgattgttgtattctttggtccatattatatattcggaatgacactttcaagggattacaggatgattgcagttataattgctttcaccatcaactatgcggcttactttgcagagatcttccgtggaggaatcgaatccattccaaacggacaatatgaagctgcacaggtattgggatataccagagttcaaacattctttataatcatcttgcctcaagtggtaaagatagtgcttccatcaattacaaatgaggtaatcactcttgtaaaggacacttcactttcctttgtgcttgcaattccagagatgtttacagttgcaaagcagattgcagcagctgaagcttccatttcagcattgctgattgcaggtggattctattatgtattcaatgcgcttgtggcaattattatggaacgctttgaaaagagattggattattacgatacatag

SEQ ID NO: 1071 - DNA, 114 bp, Methanobrevibacter ruminantium
atgatggtttttggaatagaagatccttggatttggggagtttatgttttactcattggaatgacattggtttgtgttgcctacggcgcattaaactggaataatgaggattaa

SEQ ID NO: 1072 - DNA, 1024 bp, Methanobrevibacter ruminantium
atggtaggttacgtaggttacctagcatggaaaagaacaaattcctctgaagactttttggttgcaggtagagaaactcacccatacattatggcattaagttacggggctacttttatctctacggcagctattgtcggttttggaggagtggcaggtaaatatggtatgggtatactatggcttgcattcttaaatattcttgtagggatattcattgcatttgtattcttcggtaaaagaactcgtaagatgggtaagaatcttaactccctaaccttccctgagtttttaggccgcagattcgatagtaaattcatacaatactttagtggagttttaatcttctgtgctatgccgatttatgcggcagtggttcttatcggtgcagcaagatttatggaaagttctttaatgcttgactttaatctggcccttttcatattggctgtcgtaatttgtggatatgtgcttttcggcggtttgaagggtgttatgtatactgacgcattgcaaggaacaatcatgtttatcggaatgttgattcttcttgtattcatctattgggtattgggcggtgttactgaagcaaacactgcacttacaaacatggctcacctatatcctcctgatgccttggcagaaggtggtacaggctggacaagcttccctaaactgggaagcccattctggtggactctcgtaaccactatcatcatgggtgtaggtattggagcattagctcagccacagcttgcagtaaggttcatgactgtaaaatccaataaggaattgcacaggtccctcttgattggagctgtcttcattgctgttatgaccggtaccgcttatatcgtaggttcattatgtaacgtatacttctatcagaacttcggtcagattgcaattgactatgtaggtggaaatatggattcaatcatccctacattcatctcaactgcacttcctgaatggtttgtatacatattcctcttgtccttgcttgcagcggcaatgtcaaccc

SEQ ID NO: 1073 - DNA, 1024 bp, Methanobrevibacter ruminantium
atgttagatagattaaaaagcattagtcttggaaattggatactcatcggaatggttttaggcctaataacaggcgtaatattaaacttgtatgttcacagccaatttattgacataatactcatagataacgttttctacttaggaggaaacatatttatcaagctaatgaagatgctggttgttcctcttgtcttctgttcgattgtggtaggggtggcctcaatttcagacattagaaagattggtacaatcggtgggcgaaccatcctcatctaccttattacaactgcccttgcagtttcaatagctcttctgattgcaagcttcatccatccaggtgcaggactgcatatggctggccttgcaactgcctcaaacgtttcaaccaatgttacaataaccaatacaatcttaggaatggttccagacaacccaatcaactcattggcaaatggagacatgctcccagtaatcatttttggagtactggtaggaatcattctagctaagctaaaggaagagacagaaaccataaacaaggtctttgaggaaggcaacacaatcatgatggaaatgacttcaatagtcatgaaatttgccccaataggtgttttctgtcttatggctaagacatttgcaaccttaggattcgatggtcttatgccgctgagcaaatatgtaatatgtgtgctcataggccttgcagtgcaggcattcattgtctatccgtcacttatggtcatatttacaagattgaatccgatcaagttctttaagaaattctattctgtaatgctatttgcattttcatcttcaacatcaaatgcaacaattccattgaacctagaaaaattaagcgaacttggagtctcaagggaagtctcatcatttacaatccctcttggagccaccatcaatatggatggaaccgctataatgcaaggggttgcagtaatgtttgctgcacaggcttatggaatggatttaggagcaagtgcgctacttacagtaattttcactg

SEQ ID NO: 1074 - DNA, 390 bp, Methanobrevibacter ruminantium
atgttcttagataggttttcattagaaagaaatgatttgaactttagaaaatataatttagcaatcctaattgcttctttgcttttgtatttattgaatatttattttttaagttcctttggagatttctttaaattttattttgacgatttatttgcaattatggtattgttcagctttttaaatcttgtttttccatataagatagacaatttctggataattgtaatcataacaatatttgcagcattcttttgggaatatgttgctttattcattaagccaggctctgtatttgattatttggatattttggcttattttctatctatggtgatttatttaattttgatttatgcttttgaaggtgaattgaatgtctcattttga

SEQ ID NO: 1075 - DNA, 228 bp, Methanobrevibacter ruminantium
atggaagatgaagtaatagatgttgaagattatgaagttaaggaaacagcaatagtagttagcgatgatgaagaggataatgattactctaaaagttcaaatgataataattacacatccaacactacatttagaactgcaaccattagcttatccaatgaaaagttaattatacttgctttagtggcaattgttctcattgcaatattcttattgacattttgttaa

SEQ ID NO: 1076 - DNA, 1024 bp, Methanobrevibacter ruminantium
ttggttcttatttgccctatccttgctgaagaggcacatgcaacaactgtctttctaacatcagacaacgttttaggccacgatgaggacatgcaaatgctaaatgatatcaaacagcagattgagaccaaatcaaatgggcaaattacagtcatagttgatgagaatgcctcaaaccctggagaagggactcgggcaatgaatgctgattgcgacatagctgtaacaattgcctatgcctgtgccggaaacctggtggaccttggaagctattcagtacaatccaccaaaaagataatctatgtgaatgcaggctcacttgaccttacaagcataaacttcttaagaaggtcttatgacgacaattggtcttcatccagctttgcatcccttcaaaaccctggacaatatctatatgattctggaataaccttattgcagcctggacaaaagttctatggggaaacagacaatggaaacctggaccattgcagctctgaaatagacggatacattgcagatgaagtgatgaagcaagtctattcaaatggagtaatcagaaaactggactcagattatataaacagacacaagctggatccaaaatacttagcagaagattccaaaaagattgttgacggatttggaactccaatggcagattcctatggctcatacaccacacagcaattattgtatatgagcgcatcctatttggtaggatatagtctagatgttccacaacaatttgcccctccagagaatcctgcagaatactctgcatttacaaagggaacatattcattcaatgaatactgtgaaatggcagatattgtagtggattatatgaatgagcatggaaaggctccagattcaataagctataagggagctacaatcagttattatgacttggtctataactttgcgctccttactcaagatgatttcgatgcagctcatatgaacttccctcaaaatgccgacttccaaaaatacaattcaaatatcctattggacattc

SEQ ID NO: 1077 - DNA, 1024 bp, Methanobrevibacter ruminantium
ttgatagaggaaatcttaaaaacctacaataccacaattgaaggtttaaccaatcatgaggctaaagaaagattagaaaaatacggccctaataagattcaagagcaggaaagcgacgggctgttaaaactttttttatcacaatttgccgatgcattaatctttcttcttataattgcagcgataatcagctatctaattggtaaccatttagatgctgttgtaatagttattgttgtaataattaactcaataattggatttattcaagagtatcgtgcagaaaatgccatgcaggaactaaaaagcctagtgagcaaggaagcccatgtaagaagggagggcaagacaaaaatcatccctgctgaaaagcttacaattggagatatagtcctgattgaagagggaaacaaagtccctgcagatctgcttctcgttgaaagctatgaccttacaatagatgaatctctgctaactggagagtctgaagaggttagaaaaaatgctgattattccaatatgggcaatcttgaggaaaagataagaaatatttcaagccattaccaagaggaggaattaagagaaaagattgtctcaatgaattccaatgtattatccggtagaggcactggtgttgtgattgcagttggaatggacactacaatcggaaagattgccactatgattcaagaagaagatgaggagactcctttggctaaaaaagtggacaagcttggaaaaagaattggagctttatccattgcagtctgtattggagtattctttatagatttcttccaggattataatatcatagaaggatttatgactgcagtttccttggctgtagctgcaattcctgaaggattacctgccgttttaacattgactttggctttaggaatgcaaaagatggctaaatcaaatgcaatagttaaaaaactttcttcagtcgaaaccttaggttcatgtacattcatctgtacagataagactggaacattaacagaaaatagaatgactg

SEQ ID NO: 1078 - DNA, 123 bp, Methanobrevibacter ruminantium
atgaatttaatagcagatattgcaagtggtctcttttggatgagtttagttatgattggaggatttattgttgttattgcattaatgactttaattggaaaaggctcttctgcagatttctaa

SEQ ID NO: 1079 - DNA, 546 bp, Methanobrevibacter ruminantium
atgagaactgaagttcgtatagctggttttggaggtcaaggagttatcatggcaggaatcattatcggaaaggcggcatccctttatgataatattaatgctgtacagacccagtcctatggtcctgaagctcgtggaggcgcttcaagaactgaaatcgttgtaagcgatgaagagattgactatcctaaagtgacaagtccagatattcttgtagctatgtcccatgaagccctaatcaaatatatgggtgacttgaaggacgaaggtgttctaatcattgaccctgacatgatcgttgaagaggaaattgttgattttgtaaaagagcacaagatcaagctctacagagccccagctactaagacagcaacagaagatgttggccttaggattgtggcaaatattgtgatgataggtgctattgtaaaggtcactaatgtggtttctgttgatgctgctaaaaaagctattttggatagtgtgccaaaaggcacagaggataaaaatattcaagcattcgaagcagggtatgctttaatttaa

SEQ ID NO: 1080 - DNA, 762 bp, Methanobrevibacter ruminantium
atggatttgaaaaatataaaaattgctacaatcattacaattattgcatttataatcattggcctatatgccttgactgaagtaaactacttctcttacaagaatgttgtggaacatgatgatattaatgcgtctgtagtaattattccatccattggggtttttgagaagataaacaatgtttccatctctcaaggggtttatattgatcagatgtctaatcttccaaccaagggagatgtggttctatttggacataggacattgcagggatctcctttcttgagattggacagtttgaagaagggagatattgtaactctcgaatggcctgagataggtgagataaactatacagtcaaatcttctaagatagttccagccagctatggtctgtatttaaatgaaagccatatggaaggggatattcacaatcaggaaatttatctaatcacttgccatcctcttggttcttcagctgaaaggcttattgttgttggagaattgaattctacaagtctaatcaatgaaactgctttggaggaaaatccacatgcatcatgggcatggtatataactttaggattctttgctttaggattgattgtttcatttttatctcctgaagaggaaaggaagattattttagcagttgtgattataataactattattttagtttatttctgcttattcccaatttcttctcagatttgggcagatcaattaggatggctgaatagtatgatgggtgttaattaa

SEQ ID NO: 1081 - DNA, 1024 bp, Methanobrevibacter ruminantium
atgtctaatcgatttaattcctttaagaaaggaatttctaaggttaaaaatatatctccaaaaattaaaggaaattcaaatcgaaagaagaataattctaagaataaaaggtctaaatcaactattgaatatatagttcctgaaaattctccattacgtaagaattcgactgatttagactctgattctggatttttcaattctgattatttggatgatttgcctgagggtgtgtcttatactcgtccagttggtgatttgtctgaaggggtgacttatactcatcctgcggatgactcatatgatttggatggagtcgataaaagatatgcaaaatatatttttggagatgatttaagtgatagaaactttaaggatcccagagattcgagctatatggaggatttagataataatgatggtttaaataatgaatttggaagaaataggaattttcataaaagtaggaattatgcagataaacgctttaacaatgatttagataataatggtgaaaattataaaaatgattcttatttggatgaaagttattctgatttttcttttaaaaaggatttggataatggctatttgaatggtgatgcttatttaagtaattctgatttttctgattttgataaagattatttagatgattctaattttaagagcagtcactcaaagaaagcttcccttaaatccaatggtattaaaagcaaattgcttaattttaaagatggccttttgaataaggatgacaattccaagagccgctttggaaaaattgtttttatcttgatatttttggttttggcatcatctatgttttatttctttgtataccaaccatttcaagatgaattaaatttggaaaagaatgcaaagctgaatgaattaaatactctttataaaggtccattggaagctcatgagaatgcatatattttaaaaaatcaaatagaatctgaaaatgatataaatgaactaaagaagattgatattttaatgtatgcgacgaaggatt

SEQ ID NO: 1082 - DNA, 945 bp, Methanobrevibacter ruminantium
atgagattaaaaagtgttggaatgggatattttttagcagtatctgatgctatttcaattttaaacatagcatttggattcttagctattttaatggttattgataacaatttaatatatgcaagtctatgtatccttcttgcagttgtttttgactctgtagatggatgggtttctagaaaacttaatcgtgtggatccgttaggatttggtatgaatatagattctttagcagacattgtatcctttggtgcagctcctatggctatattatactccataggttcaagcatttcatcttgggccggatatctgatagctattgtatgtatgattactttagtttgcggtcttttaaggctgaccagatacaatgtgatagctgataaaatcaattataggggatttgtaggccttccaattccggcaacagccataatattggttacctattatttaagcggattatttaatattgctgttgcagctgtcttgatgttgcttgcttcatttttaatgataagcacaatcagatatcctaaagtggataactattatcttattggtcttggagcgctaatgatcttattgttgattttgccaatacaagtatttattggacctattaaccttcctgctttagtattgtttgttttagcattggtttacatgttcatgacattcctagagttctttattgatgatgacatgacatttgatagggataaggccagtgataaggtaagcaatgttagggagattaccgaaagcaaggtcagcagttctgttactaatgtaaaggacgtctttaagaacatgaaagataccatcaatcaaatctccaatgaggatttggatgttggtcttaaagaagatgctgaagaggaaaaggaaaaagaagaaaaagaagttaaagaagcagaaatagtggaagaagtagaataa

SEQ ID NO: 1083 - DNA, 402 bp, Methanobrevibacter ruminantium
atggcaattgacattaagcgtcataaggaaaagcttagacaggacgaacctgaaatcaaactggttcctttcattgacattttatttacattgcttatatttttagtggttacaagtacctttggagctgctacagttgatgataatggttcaggttctggaaagccgaatatgacggacactactggtgatgcggagtattatttgattcctgttgccggtttgcagaaagttactgtagatggtgtggatatgtcctctgagattaagggaaatgcaattggtgtgcatgcaagagtccttgaccagggagatgttcagattaaaacgagtgaacatgcgataattattaaagcgcctccaggtatgagtccgcaagaagcggttcacacgccagagtag

SEQ ID NO: 1084 - DNA, 840 bp, Methanobrevibacter ruminantium
atgattatagaaatgctaactgatggatttaatatgattatggagatgctgcaaagcggaggagttatcacctatataattctcttgcttggtatctatggtcttttaatatccattagaaaaatattttaccttaggaagataagtaaaattgatgctacagagattatggggacaattacctcttctatggaacagggcggagctattgaagccttgaagaacatcagtcactataagaaccctgtttcaagaatcatgtctgaagcattgaagattggctataagaataagacagaagttgaagaaagtatggagcagatttttattgtcgaattaagtaagatgacaaatgggatcagtgctttaaagaccattattgagcttgctccatttttaggtctaatcggtactgtgcttggtatttggatgacctttaagaatttaggtgtgaatccagatgctgctgcaatggctgaaggtatttacattgctcttattactacaattgctggtttgactgtagctattattcttatgcctttgtacacttatattaaaggtttgattgatgatgaaatggataaaatcgaattggcaactaaaatgactaattggagttatgcagttattaagattcgtgtttatgaaaaattgccttgtgtggttgaagctcttcaagaggcagatggtatcgtaagtgttaaggagattacagatccttattccaatattcagatttcattcaagcctagtatgcttgaaaagagtataagcaatatcattttagagaaatgtgatgtaaagtctgaaattactgaaagtaagttgagacaatag

SEQ ID NO: 1085 - DNA, 1024 bp, Methanobrevibacter ruminantium
ttggcttcctttattccaaccctaaatggattggggtttgcttatataggcgctaaggagtttaaaaataattggattattgaaggtgtgatttacgagattccttggtttttattatttatctttgtaaataatgaggatcttggagtgttctttgcaacaataggcttattgggaatggctgtttcctttgttaggtcactctatgtctactataagcataaggacatattgatagatgacgatgccgaaagtcggataagcactgaaaagtccatcacttcattttgggttatcttttctgttataatctttttaaatgggcttggtttgatatatgtcggatttaaaagaaacgttcggcaatggatattggaaggtgctttctttgaatttttatggcttctattttttatcacccccagcaataaggccttaaacagttttatcatttcacttggatttattggtatgattctatctgtcattagaacatttatggtctactttgaagaggaaagaatggatggaggcttttacagtccaacagctgttaagaaggagccacctgctcaaaatcctattgaaaacacaatcaattcttatagtgagaacaatctttcagatgatgatatagttcctgagttcaagggatataagactcaagttgaggatttgaaagacgcttttaagactaaggaagacaatgttaataatttgttatctaagcgttttactaaagaagagcttagctatggcagattcaagtcagttgtaaatgagtttcataagacattctattctcaggcagattccactttaaccatgattaatctggctccagaatacagcgaaagagtagatgagaccataaaaaataagataggacttatggattcattgcttggtgagatgaataatcttttagaagaacttattcttaatgatggacttccagagaagtcagatgaggaaatcactgaattatttgaaaatatgcataatttgattaattctgttgacg

SEQ ID NO: 1086 - DNA, 1024 bp, Methanobrevibacter ruminantium
atgggaattaaagaatttttcctaaataaagaaaaaagaaaaatcgttgctattgagaaagacttaaataataatttaagcattttaggaggctattctatgggaattaaggaatatttcatagagaaaatcgacattattttcattctaatctccataattgctattgccttagaccttttaggtgtagatatttatggaatcagtcttatttggatagcaattatattctgcggcattccaatctttaaggaagcggcaataggtctttacactgaatttgacataaaggcagatgttcttgtgacaattgcaatcatatcttcaatactcattggggaattgtttgcagcaggggtgattgcagtcatcatggcaatcggcggctatctggaagagtatacagtttctaaaacaagagcgggaatagaaaagcttgttgatttgaccccaagaaaggggagattgattgaaaactacaacaagtccaatgaatctgaaagggaaatctcagctgatcttattgaagttggagacatattgaaagtggttcctggagagactgttccagttgatggaaaaatcataagtggcgagacatcaatagatcagtccgtattgactggggaatccattcctgtagataaactggaaggggatgaagtatttagcggaacaatcaatctttatggttcctttgttatgaaagcaatcaaaaagggtgaggacagttcacttcaaagattgattaaattggtagaattctcaaatccaaatgatgcagagattgtaaagactgcagataaatgggcaactctcattgttgtaattgcatttatctgtgctgtcttggcattggttttcactggtgagataatccgtgctgtaactgttttggtggtcttctgcccttgcgcattggttcttgcaactccaactgcaattatggcatctattggaaacctaagcaaaaggggaatcttggtaaaggaaggaataaccatcgaaaagttggctaaagtgg

SEQ ID NO: 1087 - DNA, 1024 bp, Methanobrevibacter ruminantium; identical to SEQ ID NO: 957

SEQ ID NO: 1088 - DNA, 1024 bp, Methanobrevibacter ruminantium
atgaaggttgtagtatgtgagaactgtggtgcaaaatatcaattaaatgatgatgatgatattaatgcatttgaatgttccaattgttctggaagtttaaaagaacttgaaagcttttcagatgaagagattcctaaacaatctgatgaatcatctggatctgattcagttcttgtttattgtataaattgtggtttaaaattccagattgaaaaagatgacaatatcaatgattttgaatgtgcaagctgtggaggtcctttagattatctttccaataaatctgaagaatctcaagagtctcaaatctctcaagactctcaaggttctgatagttattatgaaactgtttcttatgttcaatctgatgacatcattcctattcatgccgaccctaattattctgattctgatgacatcattcctattcatgcagaatccgattcccaaaccccatattacgaagaacttatagaatctgatgaaatttatgcaaatcaatacgaagatgatgatcaatactatgtaagcgaatatgagaaagttcttcaatctgatgctgattcctactatgaagacgaatatgacgatcaatactaccaaacagaccttcaagaagaaggctcaggtcaaatcagcttagatgagctttattatacttcagaatatcctgcttatgatggaactgatgaaattattcctattcatgctgaaaaaagatatatggaagattcacaggattcaggatttgcatatggtcctaatggaaaatacgctgaagactacttagaggaagagtatattgaagaggagtatgttgattctgtcgaagaggaatctccttatgtagaggttatagacataccagaggatgagttgccagaaactcctgttgttttaacaaggcaagtcctatctgaagaggatcaaaggctatttgacagggttcaaaaccaaatggtatttgacagccctgaagaatatgaggcatttaaggcagccagatacaaatattatgtaggat

SEQ ID NO: 1089 - DNA, 1024 bp, Methanobrevibacter ruminantium
atgatgttttctaatatttccaaggatttaaatattgaaagaaaggattatttatgcctattccttttattggtctatagcgcaataataactgtccttttaatcaatttcaatgaaagtattggaatatattgttcagatgtctatatctatctttataattcccttgtatttgcccgaatgggctataacaacacttatctatatctctctcctttggattttggtcttgtggaacttcattttttatttagactcggttttgtgaatgaagtgtccatttatgctgttactggtgtattttcaatctttggaagcttaggaatttatgttttgctgaaaaggtatttcaattctcttttaagccttgccggaggagtgctttttacaagcttttcattgaatctgctttggtgggcaaatggaactttagacttgcctgctgtaggattgtctgtttgggcgattctatttttaatccttgcagttgatgagagtccaaaatattatatcctttcatttgtctttttggtcttaagcatcttcactcgctacacctgtctctttctgattccattgtttttgctctattacttatctaaacatgatttgtttggctttttagattcattaatctccgatagaaaagaagccttttcaagtctaagatcatttttaaaaactgaagagttcagatatcttatgattgcattggttctggctttgattgttgctgtgcttttcatttcagtgattttatattatggggctgaactttcatttctagagcagggaagcacattcgcttcaggttcaaagggagcattggatgattatgcacatactacagataccttattctacttccatgactttttaaactttttattctcccaaaaggtgattttccaggagaatttcattccaacccttaccggcgcaagctatcttgcttatttgattctatttatattgataattggaatttcactgggtatttatagatttttcaataagaacaaat

SEQ ID NO: 1090 - DNA, 882 bp, Methanobrevibacter ruminantium
atgaacccatatttagaaattattaggccgggaaatgcagttatggcagccatatcggttgtcttaatgatgattgtaggccattattacgacttgccaatcattctttgtgcagttatcgtctttgtttgcactggcgctggaaatacaatcaatgatgtattcgattataagatagatgaaatcaataagccaaacagaccaataccttcaggaagaatcagtctgaagaatgcaagaaactattcctaccttctttttgcaatcggaatcatcctaagctttgtgattgattatatgatcaattccatatggccttctgtaattgtcgttccagcagttgtaatcatgtatctttatgcaagaaaccttaaggcaatgcctttgattggaaacatcacagttgcaaccttaacagggttctgctttgtaattgcaggaactgtaatagcttgtgctacctcctctttaaggatattgtttatttcaatttatttgggattgtttgcactatttatgactttggcacgtgagattgtaaaggatatggaagatattgaaggtgacaagctagagggagcaagaacatttcctatattatatgggaaaaagattccttccatcgtttcaatcattctaatcgttgtaaccactttgatgtgtccggttctttatatatttggaatctttaatgttttctatatgattgtgatgatagttccaatatgcatgttcctatactgcgcttatagtttgaagcttaatcccccagaggaagtttgtgcaaaggtctctaagaatctaaagatagctatgctaataagctttgttgcttttgttttaggttcatttgattggtttagcatttttgctgctctttaa

SEQ ID NO: 1091 - DNA, 615 bp, Methanobrevibacter ruminantium
gtgagaaaaatggataaaagaataaattttgtatcaatctctagatttaccctccttgtggctatttttctattgataataaataagatacagtttcatgcaaagattttagattatatggccttagctttagccatatttgctataatttgtattatcatctttatcatacaatttaaaaagggattggttgagtttcctattaaagttgttgttgaaactaatgttgataaggctttggctgatggggctattactgaagagcaagcggaaaatattccaaagagggttgttcttaatgcaaacgatatctttttaaatttagtctttaatcttgcaattgccaatcattttgatctcttgcctgtagacgttcttagggagtatataccagacattcctccagctaatcttatgagattgtatgaaaagtctagagagataagtgatgatttgaatgattactttaggtctcaaaagttcttaaataaggccgatgttattacccgttctgatgagataaaaacatatttgagagagacttatccttggatggatgatgttactttggataatacttttgattacttctttttaggaattggtaatggataa

SEQ ID NO: 1092 - DNA, 1024 bp, Methanobrevibacter ruminantium
ttgtctaaaaaaaataaggctaataaaaacaagaaaaagaaagaaagtgaccaaaccattcatgaattagagattggaaaactgattaaaaacgaagatgtgctatacataaacaatccagattactttctgacattcagcgacctggagataagcgatggaatagacataattgaaaacatcatgattctctctaaagattatgttagctttaataggcaatatgaagatgaaaagattagtgacgttgaactgatggaaattactgaagaatataaggaaaacaacaatatagaaggaggatacataagccaaagctttgataactcccaattcatcataaattcctacaatgacataacaataatcacagtaatttctaacgatttggaagtccagaagttcacagacaatctgaaagttgtaaacagctggaaaggattccacaatgcaaagataaactttggacagatcattctaatagaccatgcattaagccctaagctgctcattcagctttataagaccgcaacaaagcaaaaggcaaaattctttgaatcccttcacatgcccctccatataaacaatatcctaaacaatgaagatttcttggttattgcttccaatctgccagaagagaccttaaatcaggattatataatggaaataggattggacatcacaaatatggaatatgaagatgacaaactggaccttgaagagtttcaagaaagaattgaagatggggtcaccataagctgcgaggacgcaataagaaagatcaatctgaatattggaattctagattactttgttagcgaaggaattttaattggagatttggtagagcttggaatggaacttttagaaaacacagagcctacagatgagctaaaggaaaagctgaaaaagcaattgcttaaatctgtcagtgacagaaacattaatgcattgattatggctgcaatacgactggaagatgattttagaaagcaaagagttcgtgagatagatttaaatgaaa

SEQ ID NO: 1093 - DNA, 1024 bp, Methanobrevibacter ruminantium
atggaatgttataatcaccctgatagagaagcagtcactacttgttctgtttgtggaaaggccgtctgtccagattgtgctatggaaattgcaggaaatgtctactgtaaagattgtgttaatgaaattgtaacacaaagcataatggaaaaggcaagcactcaagctcctaaagaggcagccgaaccaataactgaagaagttcaagaagctgaagcagttgaagaagctatcgaagagcctgttgaaatcatcactcctgttcaacaagaggaagttgaagagattatcccagaaactccgaaaaaagctcctgaaaactttgagcctgaagttgaatacgaaacagaatatgtagagacatatgatgaagacggtgtggaagacagctattatgaaaatcctgaaataattccagaacctgaacctgagtataaggaaagagaaagaattgttaaagaggaagcaaaagctaaagaggaagaggaaataattgagccagttcataaaactgaagacattccaaaagaagcctatatggatgatatggaagcagacttttatgaggaacaacctagcaaagctccaagtaaggaccttgaagccaaatatgagaaatatttggaagacctttattacgatgaagatgaaatagaggaagaaatttacgaagctccaaaaactcaaaaaagacgttcaaaacctagaagacctcaaagagaagatagttactatgatgaagaccataaaagaagtcctagaaactattccaaccaaggagaatactacatcaaccctagagaagaagaatttgaggaagaagaatttatcactccaagccatagcagaaaaagagctagaagcgaagaaactgaaagctatgaagagttaaaaagaagaatcgaaagaaattatgctaaagagcaagaagctaaagaaaatcgtagattcagaaggtctaaaaagtctaaaaaacaaaaaagacctgactatgaatatgatgaattagaaaacatacaagaaa

SEQ ID NO: 1094 - DNA, 252 bp, Methanobrevibacter ruminantium; identical to SEQ ID NO: 713

SEQ ID NO: 1095 - DNA, 207 bp, Methanobrevibacter ruminantium; identical to SEQ ID NO: 714

SEQ ID NO: 1096 - DNA, 738 bp, Methanobrevibacter ruminantium; identical to SEQ ID NO: 715

SEQ ID NO: 1097 - DNA, 321 bp, Methanobrevibacter ruminantium; identical to SEQ ID NO: 716

SEQ ID NO: 1098 - DNA, 702 bp, Methanobrevibacter ruminantium; identical to SEQ ID NO: 703

SEQ ID NO: 1099 - DNA, 702 bp, Methanobrevibacter ruminantium; identical to SEQ ID NO: 704

SEQ ID NO: 1100 - DNA, 873 bp, Methanobrevibacter ruminantium; identical to SEQ ID NO: 705

SEQ ID NO: 1101 - DNA, 1024 bp, Methanobrevibacter ruminantium
ttgacaataatttcaaaaaaggtagaattgattgaactcttctatgatttaatattcgtatatgcaatatcaaggcttacttcaattataagtgaacctgtcaatggaggaatagctccattcagtctatttgcatatattatcacttcctttgtcattttacaggcatggctctactttactaactatgtaaaccgttatggccaatggaagtggtatgaatatgtcattgcaatcataaacatgattgccgtaatctatatggcaaataccatatcctcgacttggaacaattattttgtatttaatgtttccatgctgataatgctctttacggttgtatttttgtattctgttcatgccataaaggaaaaatcattaaagggagctgcaggtaattcaatcactattctgcttgttgtatgttccatttatattatatccacattatcaattctatttgggcatatggatgttgtcatttggctcaatgtccttgctatcttgactggagcctttttgccgtttttccttaagggaaaattcgataagtcaattatcaatttccctcatttgatagaacgatttgaattgctgacaatcattacttttggtgaagctgttgtgggaataacacatttctttaatgtaaacaactttgattttgttccaatacttgtattcctgattgtcataggcatgtttggatcatatgttcttcaaattcactatctagtcgatcatcatagggaagagagaagcctaagattgatgttcagtcattatttcattgtaataagcattaatctggttactgttgcctttgaattgattcacagcggggagataaactattggataccgagcctgatggtgataatttcattgattgtcttctatctctccattatggccaataaggaatattattatgatggcttagaattaagaaaaaaggacattgcattaatggttttgattagtttaataggaagtattgctattttactatctgttggcagca

SEQ ID NO: 1102 - DNA, 444 bp, Methanobrevibacter ruminantium
atgtttataatcttcccattatttagcgctaacctaatttccatcattattggaataagcgtattgatatttggtataggattggcatattcctcattcattacacatgaaatctcaggtgccctatcttcagttatgggaatctttgggattgtaatgataatctttggattatgtttcatatttgcaatcaatgcaatttccttccttgtaggattgcaattctacattgtagcatttatgctgattatgattgctgtagtcggattcctttcagatagcaatgttgctagaaccggcgctttattgtatttggtcctaggtatagttattttgcttattgcaatgtttgctgcagaaaaccctatactaattacaattattttaggtgttattttaatagcacaaggaataatgggattaatatatggcaatgaaatataa

SEQ ID NO: 1103 - DNA, 1024 bp, Methanobrevibacter ruminantium
atgagaagagaatgtttaaaaatcataggaactgcacacgtgtctcaaaatagtgtggaagaagtaaaagaagctattttagaagacaaaccagaagtagtcgctattgaattagatagaggaagatacattagattaatgaatgaaagaaatggcattgtagaagatgaccaaatccatattaccaaaatcataaaagaaaacaaagtaggggttttcttagttacaaccatcctttcctatatgcaaaacaaaattggagatgacctagacatcaagcctggctctgaaatgatcggcgcaattgatgcagctgaagagacaggttccagaatcgcattgattgacagagacataaacatcaccttgcaaagggttctaaaccatatgagcacttgggaaaagcttaaattcatttatggaatcatcggaggcttgctctcatcagatgatgaggaactggatgtagaggcattgaaggaacagtctgcaatcgatgaggcaatgggatactttaaggaaatatctccaggagcatatgaggcattggtaaatgaaagggatgcatatcttgcaaacagcatattgcacattccagaagaccatgtcatagcggttgtaggtgcagggcataaggaaggaatcaacagataccttgataatccagaaacaataccgcctcatagcgaactgattgatatggacaagaaaggaggaattccttggcttaagataatccttgcattgattcctatctcatttgttgtgatattttttcttgcttggatgaatggaatccatatagaaggagacattgttcaattcattgtaataagcatgataatgggatttttaggctcaattctttcaggatcaaagctagcctctgcaataatcggaggattagttgctccactcactattatccaccccctccttgcggcaggctggttttcaggacttgctgaagcaaagttcagaaaggtgagaaagcaggacattaataatataggaaaaatcgaaa

SEQ ID NO: 1104 - DNA, 138 bp, Methanobrevibacter ruminantium
atggaaatggactcgataatcataattagtgaaatactaataatcataatattaatcgtacttaacggacttttctcccttgcagaaatcgcagttgtctctgcaagaagaatcagaatgcaaaaaaattgcagatga

SEQ ID NO: 1105 - DNA, 900 bp, Methanobrevibacter ruminantium
gtgcttctaattaaaggtgcagatgtctttgtagacggtgcaagtaatgttgcatacaacttaaagataccaaccataattgtaggactcacaatcgtcgcatttggtacaagcgctcctgaagcagctgtttcaattacctctgcatttgccggaacaaatgcgatttcccttggaaacgttgtaggtagtaacatattcaacatattggcagttgttggtgtctctgcattgcttggaacattgacagtggataaggtattgataaaaagagatttcccatttttggttgtatcttcaataggccttcttctaatagccaccatatttggagagataagcagactctgcggtataatcttcttgataatcatcattgcttatgtctatgtccttgttcaagaggcaagacaggacaaggaagcaatgtctgaagagattgaagtaaagctttcaataccaaaagcggcaatctacattgtcataggtattgccggaatcataatcggttccgatttggttgtagactcatcaagctatattgcaagcgtattcggattaagcgatgtacttattggtcttacaattgttgctataggaacttcattgcctgagcttgtaacttctattactgcacttaaaaaaggagacaatggtattgtaattggtaatgtgcttggatcaagcatattcaacatacttttcattttaggtatcagcggagcaataatgccactcccaatagcacctgaaatggtatgggacatacttttaatgacagtgattacaatcattggcgcagcctttgcatacaccaaaaatgaagtggataaaaaagaaggtgccgttttagtagcattatttattctctatatggcatttgtcattttaagaaattaa

SEQ ID NO: 1106 - DNA, 117 bp, Methanobrevibacter ruminantium
ttggatagtgatgatttggattggaaaaatagtttaatagcttatctttggatagtgatgatttggattggaaaaatagttaatgattatagaattattaaaatacataagaattag

SEQ ID NO: 1107 - DNA, 1024 bp, Methanobrevibacter ruminantium
atgccattaatcctagtggcttttgcatcatttattatagctcttgatgccacattcatgaatgtatcaatatccccacttgttattgacttaaacacagatgttggaaccatacaaaccataatcagtttttataccttgattacagcttcattgatgcttataagctcaaagatgcaggatgtctttggaaagaaaaagatattcctaactggagcattggtctacggcttaggagcattcattgcctcaatcagccaaaatgcaataatgctctttatcggatggtcactattggaaggtattggcggagcattgatgacacctgctacaatatcaatcataagtggaacatatgacggccagatgcgtacaacagcccttgcaatctcaagcgcaatcgtcggaattgcagcagctatcggaccattgtttggaggtgttgtaaccacattcctatcctggagatatggatttgtatttgaactattaattattcttataatatttatcttccgcaagagaattccaaactttgcatcaactgcaagcaaaaaggatttggacattacaggatcccttctctcagccataggattaatattgcttgtcttaggagttttaatgatttcaggaaagacaatcggattaagcataggcctaatcattgcgagcataatcgtgctaattggatttggactctttgaaaagagaaggaaggcaaatggaaagatgcctttatttgatgtaagcctcttaaaggatagaaatctatcccgcggcacattgattagacttataactgcaattgcaatgggaggctcattgttttcaatatcaatctaccttcagacagttctcaagctctctgcattcaatacagggattgtcctattgcctctcacctttggaatgcttatattttcaataatggcaccgaaattcgcaatcagactaagccataaatatgcaatgataatcggtttttcaattgctattgtgggatgcctccttttaagctatc

SEQ ID NO: 1108 - DNA, 1024 bp, Methanobrevibacter ruminantium
atgggaaataaagaagaaaagaaagctgcaagacaacgttttgatgagatcatcggcgttgcaaaaagacaccacttagcaaagctattaacaaataacgaagacgatgaagactttgaagtttcagacctaagatatgcaatggaagagctaggtcctgcattcatcaaattaggtcagcttttagctacaaggcccgatatggtaggaaatgatattgcagatgacttaaagcttttaagggacaacactccagcaactccttttgaagaaatgagaaaggtcattgaaggagagcttggaaagccattggaagaagtatactctgaattcaatgaagaaccattaggctctgcatcaatcggccaggtatatagggcaacattaaaggaaagcggcatggaagttgcagtaaaggttcaaaagcctggaatctatgacgtaatcgtaccggatgtaaagatcttgaataacctagctggaactgtagacaaacatgtatccggttcaagaacctataacttacctgcaatggctaaggaatttgaaaggtcaatattcaaggaattggactatatggaagaagtaagaaacatcaataagataacaaataactttaaggatgttgaatacattaagatacctgaagtctatcctgaatactgcagttcaaagctcataaacatggagctcattgacggatacgaagttacagaccttttcgacaatgagattgaaggcatcaacaatacagaaattgcccaatatggaacccaatcctacctaaagcaagtattgattgacggattcttccatgcagacccacacccaggtaacctctttgtaacaaaggatgctaagctttgctacatcgactttggtatgatgggagtggtaaacgacacattcagatcaaacttcgcccaattgatattgctcctattggatggaaactcacaccatttaatcaatcaattgctctatatgaatatcatctccccagaacagaacactgacgagttca

SEQ ID NO: 1109 - DNA, 1024 bp, Methanobrevibacter ruminantium
atggtccttttaggtgccatgattgcatatggtttgacacctattgctaataagattcaaacaaagattaaatatccttcgatttctatctttttagcattgatccttgttgtaattccattgatactgctatttgcatatgtattttatgaaattacagtttttgcagatgtattctttaattctagtgatttggctggaatggatataaataatgccctaaatgccttcgttggtaatttgccagttgaattgcaaggcttcattaaaccttatatgggttctctatctactggtttggaaagcgctttatcttatgtattggcttatacagttaaattggtaaaaggattttctaatgttttaattcaattatttgtattaatctgttcaatttattactttactcgtgatggagaccttatatgggaaaatatctttgtatttatccctaatgagcataaggctttctttgatagaactttctatgaaattgctaatgtattgaagtcaatattctacggtcactttttgactgcagttataattggtgttatgggcggtgtaggatattacttattaggctataaatttgctttgtttttaggaataatcactggaatatttcagttgattcctatatttggcccttggattgtatattgggctttagccatttacgccatatttgtagccggagatattgttcaagcagtcttaacagttttgtggggatttgttctcagtttaagtgatatgtatatacgtcctgtattggcaagtaactatgcagatatgccttctttgattcttttggttggatttatggccggcccttatgtatttggaattgtagggtttattttaggtccattaattttaggagtttgttatgctgttattaagtctttaaaagaagaattagaaaaggataattggaactctggagatgaagagggttctgatgatggtgatagtgaagatgtaaaagaaatttctgataatcttgatgaagtttctgatg

SEQ ID NO: 1110 - DNA, 564 bp, Methanobrevibacter ruminantium
atgaaaaagattattggtattatttttataatagttatattggttattggaggttctttagtttataaaaactataaggactctcaaaatactgtagataagtcccaagagtctatagagataagcaaaaatggaattacaatgttaattccaggtgattgggtggaagcgaaatctgaatctaatactacagctatagcagctgcagaccctgcttctaaagactcagcgggttttagtagtgttaatataaatattgaaaagaaaacaagttataattctctttcgtatgaattcaataataattataaagctttaggaagagactcttcttacgatattctatatgaaggaaatgtgtcaattgcaggtaccgaaggtatggaagcaggttatacctcaagtaagaccggttttttaaaacagcataaggccatttggtttaagcaaggggatgacctttatgttatcttatgtactgcgccacagagcaagtttgcagaggaagaaagcacttttgactttataataaataatcttaaatttaataattcaacaaattag

SEQ ID NO: 1111 - DNA, 720 bp, Methanobrevibacter ruminantium
atgaagcttatgcagattttaaagaatcttgaaagagattataatgatggtctgatttccgaagagaaatacatctatctttcaaaccagtataggcataagatcgatacaattgatactagcaataggataaggactatgcaaggcaaaaagaaggtttctcctcgcccttattcaaaatatgaagatgctaattatcaaaaaagtcgtgatgaggatgaacgtttagttgaaaaatacatccacaatcctgaatcttataatattaattctagaggaaagaaaaccaaaagcggaggaactagcccgtggtatattgctttagcagttattttcttgctttttgcatttggtgctggaattagctttggaatatttagcgaaaatacaaatagtgatgtaggagatattattacagctagtgcaacaattaatgacacagcttttcctgaagtaaaacagacttataagtacaatcgtacttcaaattatactaaatactcctcaaactcttattcaagcgattattctagtggaagttcttataattcttataattcctatggcggatcaggttattcaagtggaggctctggttattctagcggaggttctggctattcaagtggaggctctggttattctagtggaggttcttcttactctagtggaggttctggctattccagtggtggttctggttcggtatcgattgattag

SEQ ID NO: 1112 - DNA, 999 bp, Methanobrevibacter ruminantium
atgtcttatgaaatatcacttatttcaattttagaagtcgttttaacactgataatagccttattcatcggtgttttgattcctggaattgaaagaaaatatgttcaggcaagaattcagcaaaggattggacctcccgttacaagccctggattatgggcatctataaagttcctgtataaggagaatatccagccaaattcaatggctccaggattatataaggcaatgccagttctttgttttattgtagttttagctatattcttagtattaatgccatataactatcaatttatggccttttcaagtttaatcgcaattgttggatttttaaaggttgaagaggttgcttatgttcttatgggttccttatctgaatctgtgatgtctgctaatttaaggttccctgatcatataaagggggctgcaagaccagattcattggtttcatccattgaagacatcagttcaaaaagatccttaaggatgattgtatttggttcattcccattgtatttggctttatttgttccggcagcattaagcaaaagcatttatttagcagatattgttgcataccaacaagccaatggcccattcctattcactttggcaggtataatcggagcagtggtgttctttgtcggatatatgatcattttgaatgaatatccgttttcatatattaaagcaaaatctgatgttattgaaggaccgtatatggagcttgcttccaaatatcgttcatttgtttatgtgactagaggatttttaatattcactttaggattggtattttcagtattgttcttgggaattcctccagttttattctcttggaagtttatagcagctgttattgtatccttgatattgcctgttataatggcatccatcagtgcattctctccaatatttactaataaacagttatatcctactattttattagtttctgctatgggagttttagctattgtgattgctttattctaa

SEQ ID NO: 1113 - DNA, 279 bp, Methanobrevibacter ruminantium
atgtttgttctagctaatctcttaattggtccgataattatctctgttatatttggattcgttctaggttctagaatccatctggatgagaaaaatagttttaagtttaccgcaagcggaatcattgctcttattattggtgcattaatagtgtcatatggaattggacaattcccttactataatgatttgccaatagcaactacatttttaggagctttattcggccttttgattggtagtgcattactgggaggacgagcaaaaggagatcattaa

SEQ ID NO: 1114 - DNA, 525 bp, Methanobrevibacter ruminantium
atggctgaagataaagatttaaaaaccacaaagaaatctccaaattggaataaggatgaaagcagtcctatattaaaaatcatggtcttgcctatttcattcattatagcttctttaggaatcatggttattttaggaggacatataactccaggaggcggtttccaaggtggagccatgattgcaggagcaatcatattgtctgttgttgtttatactgtaaatggaagtccattaaaattatctcatagattcattagccttttggaatctgtcggagctttagcttatgtcttgcttggtttggcaggacttgcattgacaggctcattcttatataatgtaggaggaaacctttatgggcttgttccacaggctattgcagcaatattcaaatatcctgatttaacaaatgctggaatggtcccttatttaaatatagcagtcggactaaaggtacttgtaggtttaagtgcaattgtaattgccttttcccaatttaaaaaattagcggaggaagaataa

SEQ ID NO: 1115 - DNA, 264 bp, Methanobrevibacter ruminantium
atgaacaatgtttcaggagcaatggcagcagaattcttaatattggttggtctaatacttgctgctttgttctttagacatatcaatattgctgcatgcatagttgtagttattctagctgcaatattgttctttacaaacatgcctcttgcaagcaagataaagtcagaacaatccgattcattggaaaaaatgttattttatgtactcattgttcttggaatccttatttctgtaatttactgggggttgaaatatgtctga

SEQ ID NO: 1116 - DNA, 1024 bp, Methanobrevibacter ruminantium
atggtcgttattccaatattggctgctttaattgttaacatattaggcggaaaggacaagacagtgaaggctttctccattattgtaggacttgcaattcctataattgcaattcttgccgccattggggttcaatacttcggaggccacgatccaggtcttcttgcaaattcattgccttctaatctagttggaacccttgttgcaagctataatacaggtatcgtttatatttttgacaatatagaaagaatattcatattcctaatgggtatcgtcgcattcctttcaatatttacctactttacagagaagaaggaagtctcagggccttacctttaccttatctttatgggccttgcctctgtaattgcattgcttctatctaacgatatcttcaatatgtatgtattctttgagataaccgctttgactcaagtgggtattattgtagcctcaagcacagaggacaattatgaaatcgcattgaaatacctgattttaggttcaatcggcggaccgatgcttttattaggtgttggatttgttcttggaacaataggttcagtgaatattacagacattatatatgcaatcagcaataactttgtagatccttactctccaggacttgtaatcggatttgccttaatattgttcggatggctatattcagcaggattgccaccgttccacactataaaatcagcggtatacagtaaggcaagacctaacggttcagcaatacttcaaggattttcagtattgtgcatgcttgcatttggaattgctatgtataagatatttgcttatattccaggattcaatacagccataattgtatttgccattcttgcaatggttttaagcattgcaatgtctgcaatggaggtagactttagaagaatgatagcatttttagctgtaggtgaattaggatttatcgctttaggttttggtattggaactcaaatgtccattgcagctgcattgttccaggcagcaaatgaaatagtcattactg

SEQ ID NO: 1117 - DNA, 369 bp, Methanobrevibacter ruminantium
atgattatggatattcaattagcttccctatttgcttcaggcgctcttattattataggattgattgcagcaatcttcattgacaatatcataaagaagataataggtattgcatttatcgaagagggcgtaaatctattccttatctgccttggatacaaggctggaggggttgtgccaattttcttacctggcatgactgcagactggtttgcacagaattccgcttatccattgccacaggcattggttcttacaagcattgtaatcggtgcaagcacattagctgtaatgctggctttagcaatggtcttatacagaaagcatggaacattaagcgcaaaggaaatattgggggatgaaaaatga

SEQ ID NO: 1118 - DNA, 231 bp, Methanobrevibacter ruminantium
atgattgaatatattataattattgttgcggttataagtgccatcatcgcacttttacaggaagacttgctaaaatcagccattctagttggaatatctggtttcttcattgcagtgctattccacttattgcttgctccggatgtggctttgactcaagccattgtagagggagctatcgtgccagtatttatcgctttggctgtttataaaacaaaaggaggggcttaa

SEQ ID NO: 1119 - DNA, 567 bp, Methanobrevibacter ruminantium
atggctttaggtctagagggtatgaacttaataactattatccaatcaattttattaattatttctgcacttataattataattgcagctattgggattttaagaatggataaagacatgcctaatgttgtatatgcaaggattcatattctgggaatgatagatgtagctggaataatagcatttattggattaggtcagcctttatttgctcttatctatatattcttggctccgctacttgctcatgcattagctaatgcttatttccatgcagaagatgatttaaataatcctgttcttaatcctaatttattaaatgaagaatctgatgaatctgaattggaagaatctgttgatgtggcagaacaagatggtgaagaacctgaagaatctgttgatgtggcagaacaagatggtgaagattccgattccgaagaaacttcagaaaatgtagaagaagattctgattctgaagaagaagcttctaatgaagatgtggataataaaactactgaagaagatgtcgagaacttaaataatagtgagggtgacgacaatgattga

SEQ ID NO: 1120 - DNA, 267 bp, Methanobrevibacter ruminantium
atgataatggaacttttattgatttcagagtgttttttaataattgcattggttgttttcttatttgcatctatgagaatcattacttacaaaactgtctctatggggcttataggtacttcttcattaactttagcaattaccttgattctaatctgcgtcggtatgatgtggggcatagaattctttaaggacattgctttggttttacttttattaggaattgttggaacaatagcttatgcaacatttttaaggagggcttaa

SEQ ID NO: 1121 - DNA, 315 bp, Methanobrevibacter ruminantium
atgtttttatctagaatttattatgcaattgcttatttggtagtgcttattttggagattatcaaagctactatagatatggctggtaggatatttaaaggagaccagtatgatcctattgtcattgatattgataccgaattaaaaaggccaatatctcaaactatcttagcaaacagcattaccttaactccagggactttatctgttgatttagattcagaaagtcaagtgattaaggttgcagttattgctccaagagacgtaaaggatatcattccttttgagccttatataaaggggatgttagaatag

SEQ ID NO: 1122 - DNA, 738 bp, Methanobrevibacter ruminantium
atgtcatcttataagggacacacaatatttgcttttatcttatcattgctcatgttttatgacccttttgcaattgcacttgcagttatcggagcaaatatccctgactttgaccatgaatttaagcgaaaccatgttttaatcattatttccattggaatgatcttaagcatctttctttatttattgaatctgcctatttatttagggttgataatcgctttattagggcttattttccttttatcctctcatagaggctttactcactctattttaggagctgtagtaataagcattgccatatttttattggtctattttggaatggatctttcttcttactttaatttgaacactattactaatattccattaaactatgttattttagtcggaattttaatatttttagctgtcctattcttgaataagcaattggcctctattttcattcttttaatgcttttctttatcactttggtttattttggaatagtccctgtctttaagataaacgtttattctctaatattctctgtgtttttaggtctattcagccatatgattttagattcatttagtccggctggaataaagccattcagtcctttttcagatagaaaatgctataaaaaattaggattgcttttatttgctttgataattgctctttatttgattttatttccaaataaattagatttctatcttaatcttctcccacacttttattaa

SEQ ID NO: 1123 - DNA, 1024 bp, Methanobrevibacter ruminantium
atgaaaaatagaaatgtatggagaatcattatgagtgaaattaaaaaatatatggaggatttaaagaaaaataaaaccggattaaaaggaatcctcgttattatcctaatatttgcttatggaattttagggtcttactatataatgaatctcaacataaacaattctatctattatacaatcataaccatagccactgtaggatatggagacataatccctgtaacccctctggaaaagttcttttccacaagcttggctctaacagggattggattgattgcatacatatttacaattatcattacttcatttgaagaaaacttgcacgacatcaggagtggaagacatatggaaaagagattggctaaaatggaagaccattatattctatgtggttttggaagggtaggaaccgcagtttatgaagaactgatgaaaagaaatcaaaaggtaataattattgaaaagaatgaagacaagctggaagacattgaagagactgaaaatgtggtcccatttaatgcaaatgcaacagaggacaagacccttaagaagctcaatattgacaagtcattaggggtgattgtaacaacaggaagcgatgtagacaatctattcattgttcttacaacaagggaaatgaataaggacgcttggattatttcaagggcaagcaaaaaggaaaatatcaaaagattaaagcatgctggagcaaataaggtcatatcccctgaggtaagcggaggaactgacatttactttgctgcagtgcagcctaatttagttcatataactcaaaagcatggcattgattatcttgaaagggaatttgaaatacttaaaaagcacaattgccatttggaaaacatagaatatcattttccaggaattaagacaccagttacccggaccattggagttttagatgaggaagagaaggatcacttcattgatatggttaaaaacaatccagaagtccatgaatccatggatgtgatgtatgaaaccgttaatggagttc

SEQ ID NO: 1124 - DNA, 1024 bp, Methanobrevibacter ruminantium
atgaaaaacaagaaattgataatttttttaatatttggtttggcaatcatggccgcaatgctatacttcatcggtatagatcaggttgtcgacgctctcaaatattctaacctttggtttgttttattggctgttttattacagatttttacttatttcctctacacatggagatggcagattataaacaagagtgcaggcatgaccttgggaatctggaaattgcttcctatggttttagtaagcctggcggtaaacaacatcactccaagcggacgtggtggcggagagcctgttcgggcttatcttttagcaaaggaaggtcattataagtttgaagacaccttcgctaccgtaatcgccgatagggcattagacacatttccatttgtcattctagcaattctgacaattatagcaattattttcagcgtctctttacctgtctattggatagtcatattggttctttgtgttgtaggaatcactgcaatagttattctattgctttatgtctgtatcaatgaggcatttggcgtaaggcttacagaatggattctaaagattaccaaaagattctataagaattataatgatgctcttgaaaaaaggattgttgaggctgttgcaagttttcaatctacaatgaacgcattgattagggataagaatattatttattatgcattgcctttatcctttattatttgggtttttgagattttaagagtttatgtggtctttttagcctttggtgccaaggtatcccctataataattggtgaagtgtttatattggcatcccttgtgggaatggttccactgcttccaggaggccttggggctattgatggtgtgatgattttattctattcaaggtcaggaatcactgcctctttaagtgctgctgcaactgttgtggaaaggtcaatctcatttggaatgactacaatattaggtctgatcttcctcatgaagtatggaacttctattttggatgcgtcatttaaacttgcagaaagcg

SEQ ID NO: 1125 - DNA, 1024 bp, Methanobrevibacter ruminantium
atgcaaggattaggagttgtattaatagtcccaaccttagttgcattaatatacggagagtacgaccctattgctccttttatgattccttgttttgtatcatttgtcttaggaactgcttttagtaaaaaattcaaagactataccaagcttaggcttaagcatggtatgctaatatcatcctttgcatggctatgggcctcccttatcggagcctcaatcatggtcctttcattaggcatcccatttgtcgatgccatctttgaaaacatgtccgcatggaccggaagcggaatgactttttttgtaaacgttgaagtattgcctaaatccatcctattcttaagaagcctagaacaatggctaggtggattaggaattgtaattatctttatcggaattctaattcgagcaggtactgcagcatccagattatataaatcagaagctagagaagagaaaatcaagccaaacattacaaacaccttaagaaaagctctagaaatctatttaatctatacagcagtgggaatatttcttttcatcttggcagggcttcctatctttgatgccataaacatcacattcacaagcatctcaactggaggaatgtccattaagaatgcaaatgtgggattctaccaagacagcatagtctacctaatcagcatgtttctaatgattttaggtgcaacaagctttacaatacattataagattgtaaagacaaaaggaaaagcactttttaaagatgttcaattccaattattgattaccttaatcatagttgctggtgcattctttatagcgacaaataagatggtccctatagaagaactctttaccatagtttcagcagtgacaaccacaggggcaaatgtggttgatccccatgtgcttgcaacatggaacgggtccacattgattgttctgatggtcttgatgcttattggaggttcatcaggatctacaggaggtggattgaagctcattaggattattacagtgcttaaaggaatgaact

SEQ ID NO: 1126 - DNA, 843 bp, Methanobrevibacter ruminantium
atgaaaaaatcatcaataattatattttttgcagtttttgaaataatagccatcctattattcattacattaaatgatattttctacctattcaatttcacatacataggagcctgtctatcaatcggtctttatttgtacaatgtagatagcaaatattcaaaatacgctagaaactttattcaattggccatcggactatatatgctggtttatcttggaataatctccagagaaaacatgatgatagagggattctggtattatctctttttaggggtctttgaagctgcagtgatccactatctcgttgcaaagatcttaggaccattcctttttggccgtggatggtgtggatatgcatgctggactgcaatgattcttgatcttttgccttataagactccaaacaaaaaccttgaccatgaaagaaagaattttggtttcatcagatatattcttttcattgcttccttaataggtgttggattgctttttatgatgaatgtgcctaatttaagcacagtgatgttttatctgtttatagcgggaaacattgtttactacacagttggaatcatccttgcatatgctttaaaggacaatagggctttttgcaaatacatttgccctaccacagtctttttaaagataggggcaagatactctttattaaaggtaaagtacaaaagggaaaattgtatcagttgcaataaatgctatagggtttgtcctatggatgttgatatttgcaataatgataaaaataagaaaaacggtacagaatgcattttatgcttaagctgtgccaaggaatgtggcaatgatgctctttttctataa

SEQ ID NO: 1127 - DNA, 342 bp, Methanobrevibacter ruminantium
atggcacgtcataaatctaataagcgtttgaataagggtgaagaagaagatccaatgtctggagcagcaaaccttgtggatgctatgttagttattgcagtaggtctattggtctttttagttatctcttggaacatgcagggaatcgttttcaatgaggacatgactccggaagagaagcaggaagtaatgcaacagatgcaacaggtaactgaacttgaagagggtcaggaattgaatgacactccagatgtaagtaatagttcaggtaagggctatacagagatgggtaaggtctataaggactcatctactggtaagctgattatggttgagggctaa

SEQ ID NO: 1128 - DNA, 645 bp, Methanobrevibacter ruminantium
atggtaacagttattcctggaagtgacttactaacttccgcattaaatgttgtttctcaaagtttacagatacctgtaatagtatttttattaatttttgcagtgtacgctgtaattactgtaggggggcttatctcagaatacagttctcgtaagaaagtacccgttaaagtaatcaaggatttaatatacgcaatatctagaagtgaggatgttacagaattggaaaatatccttaagaatgcaagaattccaaagaatcaaaagagggttttaatcaatatagcaagatctggagagttaaagaaagactccagagaggcattagctgaaaaattgattgaaaatgaagaggacatcattgagaaaaagcttcaaaagacagatatcgttacaaagattggtcctacccttggtttgatgggtacccttattcctatgggtccaggtcttgctgcattaggtagcggtgatgtgacaaccttgtctaatgcgatcattgtagctttcgacactactgttgtaggtattggatccggtgcagttgcatatgttgtctctaaggtcagaagaagatggtatgaacagtatttatctaatttagatgctttatctaaggctgtattggataggttgaatgaatag

SEQ ID NO: 1129 - DNA, 693 bp, Methanobrevibacter ruminantium
atgctatggcaatttggaatattggcagcagttcttgtatttggtatcaagttaggtttggctgttggtttggctaacctctcaaagaagtatctggctactgtctgtattggatatggtgcaggagtactcattcttgctcaaatttcctcctattttgctactgaaattactgagcttatctacacatataactctctgttctttattataatggctgttataatgattctagcaggtatctttacaataagggaatggaaggtctttgaaaagaatactacagctgccacttgtgctgcagtgattgccccttgtccatgctgtttcggttcaattattgtcagtatcttgttagtggctcctacagtcggtttaggtgctgtggatttaagcgtatatgtggcagcagctttggttttaactattatagttacttactttgcttcaagcatattcgttcgatatgttgataagccttatccgattgtacttggaaacttcatgttcttcttgggaatttatttcctcttgtctgcattggtcattccgaacattgcagcaatcatgaataagtcaatgggatcaatcagcatagtttcaatggaaagtttggctggctctatagttgctttagtgcttttagtagttattggcatagtattttcaagaaaaaacaatattctaagctaa

SEQ ID NO: 1130 - DNA, 351 bp, Methanobrevibacter ruminantium
atggctcgtcgtcgttgcaatagacgttttgaaagtgaggaagaagatcctatggcaggaaccgccaaccttgtagatgcaatgttggttattgctgtaggcctgcttgttttccttgtgcttgcatggaacatgcaaagcgtgctctttaatgagcagctcactcaagaggaaaagcagcaggtcatggatgctatgaatcaggagatgactgaggttcaagagggtcaaatcttgaatgagactccagatacaagcaatgcaacaggtcaaggttatactgagatgggtaaggtttataaggatccgtctacgggtaaattgattatggttcagaataattctgcttaa

SEQ ID NO: 1131 - DNA, 747 bp, Methanobrevibacter ruminantium
atgacattagctattggaaatacattgatttttgcagatgaagctatttatcagggagccaacaatggactattcgccatcttctcaaatacaaacggaactggctttccatttttagatagttcactaactgctataacacaagcattacagatacctgtaatcattcttttactcatatttttagtattcgctgtagtaactttagggaagcttctatcagaatacctttctcgtaagaaagtacctattaaattaatcaaagaaatgatttattcaatctatgatgcacagtctgctgaggaaattaaaaatatagtaaatagttcagatattcaaagttcacaaaagacaattctttgtgaacttgctgacagtgaacatcttggtaagaaatcaagggagacattagctcgtagattgattgataatgaagaggataagattactcaaaatcttcaaaaaacagatattgttacaaggataggtcctacacttggattgatgggaacacttatcccaatgggtccaggtcttgcagcattgggtacaggggatgtgacaacccttgcaagcgcaatcaccattgcattcaatacaactgttatcggtattggagcaggtgctgccgcttactttgcatcaaagattagaagacgatggttcggtgaatatcttgctaacttggatgctttgatggatgcaatattggacaatatcaataaaagggatgataggctagaataa

SEQ ID NO: 1132 - DNA, 534 bp, Methanobrevibacter ruminantium
atggaaattattgaattgattgctatcattattctagtggcagccattgtatttttaatctattattattttcagactgtcaatggaggcagttttgatatagatgatttaaaggatcatctcaccatttctaaaagggaagcagccactgccaccgttaatctggatgatgatgaagcggaagaaaaagtttctgtaggtaaaaagattaaatatacctttaaggacattgataaatcttattctaacactacagatgcattttccaaaagattagatgcatttttagatgaaagaagtgaagaattaatcgaaaattggtctttagtaaccactgatgacttggaaagtttggaaaaacgttgcgttactgcttgtgacagcattgatgacttagagaaaagattcagtgaatacagcaatgtaaccaatgaaaaacttgaagaccttgataaacgtattaaggcacttgaagaagattctgaacttctagaagaggacgctgaaactatagaaaaagaagcagatgaataa

SEQ ID NO: 1133 - DNA, 405 bp, Methanobrevibacter ruminantium
atggctaatgaaattataccaagtgaaattttcattcttattttagtggtcatattggcttttgtagtcattatcattgcattgcaatggaaaaaggtacgccaatctgacaatactttaaaattgatggaaaaagagattgagcttaaaaagattgcgatggttgaaaaggaccttgaaaataaacgtttgatggaaaatcctatttctttacctagcgaacagcaagagcagcttactcaaatcagagattccactgctaaagtcatgagcgatgtaggctatttgcatagtgaaatcaatgaacgtttagcacgtcttgaagctcaaaccgaacttaaaaaattagaaaaaatgcttgcagaaattgaagataaagagaaaaaactcaataagggcaaataa

SEQ ID NO: 1134 - DNA, 1024 bp, Methanobrevibacter ruminantium
gtggaaaagccacaattagttaattttatagctaaagtgcttgaagattctggctttaaagtctataagaactttaaaacttcccaacagaccgtagatatatatgcagtcttgccaacatcaatgggcgattttggtatggttgttgcatgcaaaaactatgacaaggaatgggaagttggaatcgatgtcttaaaggaaatggaagttatcggaaagaaacttaaggcatcaaaggtcagcgttgtcacaagttcaggattctcctcacaggcaaaaagatatgctgaagagaggaaaatcaaattggtagacagaaacgatcttgtagccttagctaaaaaatacaacaacaagaaaaaacaggaaaatgaaccggtaagacttagaaaggaaagtcctgctaatatcgatagggattcattctataatagggatgtaagccgtgactacatagacaatgtaaatggcacccaatatgatgccggactcaatagagtcccaaatccatatgacagctatgaggaatatgaatcagatatcgattattatgaaaatcaggtgggaggaattgacttaagcggatacagcgcgtatgatgatgacttatatagggctgaattccttaataggcaccctagcaatgaatccaactataatggattattgattgcaaacaatcgagacccatatgtaaattccaaacctagttccaatagcagaagtctattctctagaaataaagcgactgaaaagcttagcagcttaaattcaagaggatacacaaaaaatacaaacaataataataacagacaaagaaatagcagaaccacaactgtcagtagaaacaaaagtccttcaagaaatttcatatcttcaagggacaatgctttatctaagttctcaagaaatgaaagcagatcaagtggcggtttaaaagaaatgattaagccaatacttggaaatacaattgtttcaatcattgttgtaatagttgttgcttatctgattgcattcatacttg

SEQ ID NO: 1135 - DNA, 825 bp, Methanobrevibacter ruminantium
atggatattttacaagcaataatcattggacttgtccaaggattaactgaatttctacctgtaagtagttctgctcatttaatatttattcaacaagcattaggattaagcaatgttccacttgcctttgatgtcttattgcatgtaggaacccttgtagcagtatttgtatacttctttagcgatattattcaaatgattcaaggattcttctatagcctattggatttaagggatggaaatttcattccagaaatcagaagggacccttataagaagcttgcatggcttacaatcattgccacaatccctgttggagttgtaggaatcctattcaatgacattatagaggaaatgtttacaggattgaccatacctgcattcttgcttcttataacaggatgtcttttatatgtatcccaaagaatgaacagtggaaaaattgatgttcaaaacataaccatcaaagaagcattgcttatgggatgcggacaggcaatagcagtattgccaggtctttcacgttcaggaaccacaatagctgccggattatttgcaggactagacaaggaatttgctgccaaattcagctttatcctatcaattccagcaatcttaggtgctgctgtagttcaattgaaagatctaagcggaggcaatatagagattggtgcatgtttagttggatttatcgtagcagtcatttcaggatactttgcaattagcttcttgcttaagatagtaagggaaaagagcttagacatatttgcttactattgttggatagtaggagtaattgttttggttgggagtattcttttatag

SEQ ID NO: 1136 - DNA, 756 bp, Methanobrevibacter ruminantium
atgatgttaaactatttatttaatatattaaatactaatacatttttattaaaccctaaagagagagttattcaagggattttattgtttattctaatgagtgttttttccttattatttatatcattcattactttagcaagccctaatttatttttccctcttttaatctcttttgagcttttaatgctctttttaggattaaatatttcattacattcgatttataccaattattttaatatgttagtttctgaaaatcctgttttattgagttatgagggagttatagtaaacttattgtgcttaagtttaggagcttttagtttttggttaagcatcgctattttcatcggtcctttttgggcatttttttcatttgccttggcatggttattgcctctatggataatgtttttcaggagagatatttttaatgaaaaaagcaaggtaatatctaaaaattcagacaagcttataggatactcccctatttggttttacttatttggatgtgtttctttatttattccttttcttgtcatgtttaaaatcgtgtttttttcaaagttcaattttttagcattaggcttaataatcattactttgatagaaacaattttaattttttgtccggattattgggataagattttgccttttgatattagaacaaagaaaggcacttttatttattttttactatctattttaattttatcttgcatttctattattctttataaaatagtttaa

SEQ ID NO: 1137 - DNA, 1024 bp, Methanobrevibacter ruminantium
atgttaaatttaaataaaaaaactatcattggagtaatcctttgttttattcttgcaattccttcatttttgctaggaaatctttttccaataattggagggcctatcattgccattttacttggaatgataattgcaagcttttggaaagataagggaagcgctgaagagggaataaacttcacctcaaagtacatacttcagcttgcagtcgtattcttaggattcggccttaacctaggggtcatagtcgcaacaggaatccaatcccttccaatcatcattggaacaatatccatagcccttatcgttgcctatataatgatgaaagtccttaagatggagagaaactctgcaatactcattggtgtgggatcttccatttgcggaggctctgcaatagctgctacagcccctgtaataggtgcaaatgatgaggaagttgcccaatcaatttcaataatatttttcttcaatgtcatagctgcaattatatttccaatgcttggtagaatgctaggcttttctacagtgaatggagatgcatttggcatatttgctggaactgcgataaatgacacttcctcagtaactgcagctgcagctacatgggacaatatgtggggacttggttcagcaaccctcgataaggcagctacagtcaaattaaccagaacacttgcaatcattccaataacacttgcattatcctatataataggaaagaaagataatggagaaaaaagtaatgaagaaggattcagcttaaaaagagcatttccaacattcatagcattctttattttagcttcaatcataacaacagttgcagtttttcttggtgtggatgcaagcctattcattccaatgaaagaaataagcaaattcctgattgtcatggcaatgcttgcaatcggcctaaacagcgatattgtaaaacttgttaggacaggtggaaaaccattgctgcttggtgcaagctgttggatagcgattaccattgtaagcttgattttacagcatt

SEQ ID NO: 1138 - DNA, 1024 bp, Methanobrevibacter ruminantium; identical to SEQ ID NO: 960

SEQ ID NO: 1139 - DNA, 669 bp, Methanobrevibacter ruminantium
atgttaaaaatattggcagctgataaaatggacaaaaaattaatagtcagatatataatgctcattgtaggtgtaatcataatgtctatggggatagcattatctatcaaagcaactttaggaacatcccctatttcatctgttcctgctgtcctatcaattgcctttccctggactgtaggagagtttacaatagttttcaatgcacttcttgttatttttcagatggttttgcttagaaagatcaccatctcccaaatagctcagatgcttgtatgcgtcctctttggatatatgattgacttcagtcttctaatacttaattttccaaatcctacagattatatcagccaatggattctatgtatcataagctgctttgtacttgcatttggcttgcttattgaagtaaagtcagatatcaccatgcttccaggtgacggttcagttgtagccatcgctgaagttacaaatagggactttggacagatcaagccattttttgaccttaccatcgtatccattgcagccatattggcattggtatttttaggccaccttgagggggtccgtgaaggaaccatatttgcagctattgttgtcggattaatcatccagttttatgacaggatatttggatataatattgatgcttatttggctgattag

SEQ ID NO: 1140 - DNA, 1024 bp, Methanobrevibacter ruminantium
atgaacttagaaaacaaaagcattgaccttttaaatccatttatcataatcgctatggtaattgtattcataatcattgcccttcctatgtggtatgcttaccaaaaattgccaagtcccagcatggacttatttctatacataggattaggccttattttcttcatatttggaattttgataagcaatctattgctaaacagatttttaaaaaaggatctctctttagattcccttaaggacactataaaaattagcataagcaaaaatccaaaaaagctttcaatctttgaatcctactcaagaaaggaaatgattctggtcatcatggttttaatcggaatcatccttcagataatcaacatagttcgtcttggaggaataccattattctcagcaacactaaaggctgaagctgcaggaaagatatggctcgcatcatatataatcttcttgccatttattaacatactccttgcagaattcaatagggattcacattatcttttagtatttttaggcttgcttttatttactttaactggctatcgaactacaccaattgcaatcgtgttatctatattaattacattatattatacaagaaacataaaattcaagtatcaggtcctatttttaggactctttttagtcattgcagtggcacttctgcttgctatagggttcatagcggtacaggcaataagctggcagcactggagccttaatccaatagaacttgtgtcatatagggcggcatttacattgaatgttcttggccatgcaatcagcaatcagtttgcaactgccggaaagcttttctactcaacccttacaggatttttcactcacacagaccctagggttcttgtaggtcaagcaactcttggaaggaaccattcaataacatctacaatattcggaccggctcttcttgactttggattgattggaatgtgcattcaaatgctcttgatcggattcattttaaagacattgcacagcattcaaaagcataagaaag

SEQ ID NO: 1141 - DNA, 792 bp, Methanobrevibacter ruminantium
atggctaccgtagacagtttcctaccggatttcatacaaaccaccttcttttcaggatacactatattcaatacagtcatctacactctaattcttcttatttttataatagcaatcataaagatgtttaagaagataaaaatagaccctatctccataatctatcctatcatcccatatatctttcttggatctctcatacgtgcattggttgacaatggggtctatccaaaaacagtcttcttaataacccctggcctttacatacttgttggccttataacaattgcatcactgctattcagtctatttctatacaacagaaaaaacatcgactatagatacaccctttcaatcataggagtcatacttctcataccaaacataatcatgattcctagactaaacattattccagtaatctatgtgctaatcacatggataatagcaagttcaatatttgtcttgatttcatacattatcccatttttcaaggacaggataaacttgtcaataatttcagcacatatgttcgatgcttcaacaacatttgttgctgtcgagttcttcaactacagcgaacagcatgttttagcaaatactctatatcaactatttgatacatctattacaatgtttcctatgaaaattatagtcatcgttgcagtattatacataatcgatcaatatttcgatgacgaaaccataaaaagtctattaaaattaaccgtatttgtattaggattggcaccaggtttgagaaactttttgactatggcaataggtgtatag

SEQ ID NO: 1142 - DNA, 1024 bp, Methanobrevibacter ruminantium
ttgagcaacaatcaaatttctggttgttcttatgccttatatctggatggaagcgataatggctcattcattggaaacaagattttcaataatgattatggcatcttagccaaatattcaaatattaatcttttcaaaaataatagtgtattcaataactggattgccattgaggactcttccaaatacaatcagttcctatccaataacatccacgataactatcaagggattcgactcatcgcatccaatagcgcattgatagagaacactaatgtctataataactatttaggcattttaaagtatagctcttcattcataaacaaatccgcatctgtttataacaatacattaataaatgttcagtcattgaatgatggggaaatagtgattcaagacaatatgtggtactgcggccctgcagccctttcaatcatcttcgaaagcctcggattaagcctatcacaagaggacatagccaaaattgcaggaacaaatacaaacggaaccagcctttacggactataccaagcctgcatcaaaaaaggattcaatccctcagtattaaagataaatagctcagacctaatgacaaatgacttagctgtgcttttaataaatgaagactaccatttctccgtgatttatagcataaacgacaccgacattgtattaaatgatccctcaataggattgtttgttctaagtagggaaacattcgacgaaatgttttccggatatgttttagatgttgaaccaataaaagatagggtatctaatgtaagcatagccaaaatgaaaactatagttgggactgttttcccagcacttgcttatggaggttatttggctttagcaggggtaactgtaattgccggctccttagcaatagtttggaattcaaactcacattacaattccaaaagcattcaaaaaccacattatacatggaagcctaataataaaattcattttccacgaaatgtcaaatatcctacaagcactggaaataacggaaata

SEQ ID NO: 1143 - DNA, 795 bp, Methanobrevibacter ruminantium
atggttaaatgttcaaaatgtgggagtgaaaataagtctgaagcaaagttttgtcatagttgcggtgctaaattagatataaaggacccatataatcttgatggcaaatcaagagagtatggttctacaacaggcaagagtgctggctctgctagcgcctattatgaccatagcgctaattctggtggttccagttcagattccaccggaggaattgataattttagaaatatgagcaattttaaaaagatcatttttgcttgctgtgctgtttttatagttttattcattttgtccttagctgctcaagcacttggatttgatatggaaccttatagcgaaaataaaaccgcttatcataattattcaagtttggatttagatgatgatggggcattatgcttggaagagcttgagatagaatattctaatatttcaagttcaaagatgagtgatatctttaaaaaatccgataagaatcgtaatcatctgataagaggcgctgagtatgatatgctgaactattatgtgaatgagcattttaaagacttggagaaaaagaaaaacgaaaaaacaagtagttccagttctagttctagctctagttcaggttccagttcatacaagtctccatttacaacaagcggttcctcggatgatggagctgaaacatgtccgttctgcggtagtgaagctgtttatgaatctggaaactcgtataaatgtgccgaatgtggtagaactatttcaaatccagatgatttagatttaaattatgatgagggctattattag

SEQ ID NO: 1144 - DNA, 1024 bp, Methanobrevibacter ruminantium
atgaaaaaatgtagtaaatgtggttcagaaaatccagataatgctaaattttgtcataattgcggctcaaaggattttggaacaaatgaaaatatttgtcctaaatgtggcgaatccaatgtgaaggaagcaaaattctgtcataagtgtggagctagcttaagctctaattcttcttctggcagttctagttcttataatcccactggaatgaacggtccttttggtgctggtgctaatgataagcctggttctgttatgaatggtccttttggtgctggtgctaatgataagcctggttctgttatgaatggtccttttggtgctggagccaatggtgtagctgattcttttgcttttgatcctagttctaatgataaatctagttctagttctaactctaattctagttctaactctaattccagttctaactatagttctagttctaactctaattctagttctaactctaattctagttctaactctaattctagttctaactctaattccagttccaataatcagggttctacggcttcttctgctaatcaatctaattcaacagcctctaccaaaaatcaatctaattcaacaatctcttctaccactgccaatacaggaaatgaagggcctggattaaagaaaatatgctgttgctatgttcctgttattcttttagttctttttataatatttgcaattttattgaatgcttttcctgaaaacttttcagcaacttatgatgacgaattttaccaattggacattgatggggatggaagattgtcactttcagaggctagtcagttaaaccctggaatgtctgattcaagcattagttcatatttcaatgaagctgataagaacaacaatggttatcttataggccatgaatttgatgacttttatagtgatgtgaaaccttattcctcatcatcaagtagttcttcttcatcaaattcccataagtattccagttcaagctcatctagctcatccagctcatctagcagctcta

SEQ ID NO: 1145 - DNA, 1024 bp, Methanobrevibacter ruminantium; identical to SEQ ID NO: 961

SEQ ID NO: 1146 - DNA, 315 bp, Methanobrevibacter ruminantium
ttgattgcacttgtccttgctcctactgttttatcattgttcacttcttctgtaaccgctgctgcattggttattgtaggtatcttaatgattgtgcaattgaaagaagttgattgggacaatatggttgtagctgcatctgtattcatgactatcatcatgatgcttttaacctactcaatttccttaggtatcgcatggggattcgtcacctacgctgttgcagctatcgctactggcaaagctaaagagttcagttggattatgtggttaatggttattatatttgcagcatacgtgttcttcggactttag

SEQ ID NO: 1147 - DNA, 996 bp, Methanobrevibacter ruminantium
atgttaaataaatttttcaaattggatgaaaacaatactgatataaaaactgagtttcttgcaggtttgacaacctttttagcaatggcttatattttaggtgtaaacccaaccatgcttgctgaaggtggaatgcctgcaacaggagtatttttcgcaactgctcttgcttcaggggtatcttgtatcatcatgggtcttgtttccaaatatcctgttggtcttgctcctggtatgggtatgaatgcattgtttacctatacaatcatattggctatgggtaacacttgggaaactgcacttgcagctgtattcgtttcaagcataatctttttattaattaccatttccggtttaagggaagcaattcttaacgctcttccatttgacttaaaattagcgattggtgctggtattggtttcttcttggctttcattggtttgaaaggtgctggaattatcgtagcagaccctgctactctcgtaggtatgggaactatcttatccgctcctgcgcttttagctgtaatcggcatattgcttactttgatattatacattaaaaaagtccctgcagctgtattccttggattggtaataactgcaattttaggtgtaatctttacattgttcggtttcggtgctggagatccattaatgcctgccattcctacagagttcatttcctttaatttcgacacttctgtagttggagcatttttaaaaggattttcacaattgttcactaacatccctaaccttatcatgattttattctcattattattcgttactttctttgatactactggaaccttgattcctttagcaaatcaatgtggtttcgtcgatgaagaaggtaaggctgatggaattgacaaagctttccttggtgatgctataagcggaatcattggtgctatcttaggtacttcaaccttaactgcatatgtagaaagtgcaacggtattggtcttggtggtagaacaggtttaa

SEQ ID NO: 1148 - DNA, 1024 bp, Methanobrevibacter ruminantium
atggaaagagtcagattacaatacattgatttattgaagtttttcgctattttttcaatcatagcattgcatgtgtttctagtatggcccaaagcaaaagtcatgggcataaaagtatattcattatcaagtattgtaaggttcggagttcctgtttttataatgataagcggagctcttcttttaaatagggatattgaaatcggttcttttttaaaaaaaagaataaatagaataacatatcctttcctgtttttttacattataacattcatattcatagcattgactaaccatacccatgaacagcaaaacatatttgctttcagatggtatttctggacaatcttaggtgtttatttaagcatacctataataaataaatatattcaacattcatcattgaaagaaatcgaatatttcatttacatatttatctttgcatcaatattctatcaatttacttacttctttgaaataaaacaatatttttacttgactttgttcttatccccattaggatatttggttttaggttattacttatctaaaaaagactttaatctcagtacaagcaagatgattgtcatttccataatcctattcatattgtctacatccataaagatttgcggccagttaggatacatacctataactgaaaattttgttgccagccaatcagtcatcctatcttcatggctagatgtcagcttcataggaatcttgcaagcagcttcattcttcttattatgtaagagcatttatgaagcttcaaaaggtatcttttcaccaatcaagaagtttttagaatcaaatatcatttcaaaatttgttctttcagtaagcagggcaagctatggaatgtatttaattaatctaattcctacagtcattgtttattattatatacagccaatgaatttaacaggcagtcaagtctttttagcaattcccttgatttccataatcatcttcttggtcagttggattatcattgtaatattatgtaaaataccatata

SEQ ID NO: 1149 - DNA, 639 bp, Methanobrevibacter ruminantium
atgatattaggcacttatttaatcatgcctattttcaatagatggattaaggattgttcaattagggaagttgaatatttcttggctatttggctaattacttgcatttttgacaatactttattgatcggattccctgttaccttgacctactttacaggaccaataggcatggtggtattaggatattatttaaggcatacggatagaaaaatattcaatagccttccatatgcattagctttcttattgattggaatgattgttataatgctatgttcatatttcctatctagtccagagggaatgtatgtctttgatagatattctattcttttagcgattgaagtagttggaattttcaccctttataaggtcattgataaaaaagagcttaaaatcttccataaggaaaatggtttttttagaagagcatctttctcaattgcaaaatatagctatgggatttatttatgccatgaatttattatgaatatctttattataatatttttaaaacatgctccatttaaagtaaccttgcttttagtctttgtttgcacattaggaacatcttgggctctattggctctattaaatagagttccatatttaaataggattatcggtgctaaatag

SEQ ID NO: 1150 - DNA, 1024 bp, Methanobrevibacter ruminantium
atggataatcaaaatcaatggaattcaagaattgcttttttattatcaatgattggagctgctgttggattaggcaatatctggcgttatagctatgttgtttactcaaacggtggaggaactttttttataccttatttagttgcaattctaatcatgggaattccatttcttgtattggaatatggaattggattccgccataaagactctttttccaatatcttaaagagcatcaatcctaaattggaatacatttcatgggcattggttttaattatctattttgttctaatctattatctggttatagtaagctgggatttggtctatttaggctcaagcataaatttcagctggggagctgattctgctctttatttcgtgcagaatgtcggaggaagctcaaacctctccaatatggcaagctttataattccaacaaccatttccatggtcttagtgtggatttgtgtctggtacatctcccacaaggatttaaatgagggaataggaaaggcttcaaagattctaatccctctgctttttggcataatggctttcataattgtatttgcattgacccttccaggtgcaggcataggcataagcgcattgctgaatcctgattggcaaatgcttttgaatgtaaacatttggcttgcggccttttcacagattattttctcattaagcatgggagagtcaatttcactgacatatgccagctatttgcctgaaggatctaaattgaccgacaatgtattgattgtggtttttgcaaattgcgcatttgaagtctgcacagcttttggaatattttccattcttggttatatgtcctacacttccggaacaccgattgtagaattggtaagcgaaggcacaggacttgtatttgttgttttcccaatgattttcaatattatgggtgctataggtcatataatcgctccattgctatttatagcaatattgttcgctggaattacttcagctgttgcagtatttgaaccgatgataa

SEQ ID NO: 1151 - DNA, 1024 bp, Methanobrevibacter ruminantium
atgacaattaaaaaatatttcaaaacaagaaaaggaactaaaaaatcagtccaagaaagagattatgatagtgattactcaaataaagggctccataaagaatcaagaattaaaaacttgcttaatgacaataaaggaaactattcaatcgtcattagtgcaattctactaatatcctttttgattctctctattattgtgctgaacacagttttagaggaaagggaagaacatacagacacaatagcttcaaaccaataccaatacatcatagaagattataagcgaaatttacctaatattgagcgtgaggcattggaagagctgagcttatatgtcattgagaataaaagaccctgctttaactctcgtgatgacttaaaggagataatagatgaaaaactggctcaaaagaatcaggaatattatcaaaactataatattgaaataaactcctcaatcatagggattgaaaacactagcgatccattttcctataagtttaaaacatatatttcaagtgtaaagggagacttttcctatgaggagatagatgaatcgtatgtgaactgctataatctaaaagatccagtacctgttctcttttgcggtgatgattcaagctttagaatagaggactatagtcttttaggtgactctgattttggaactcatgactccaattttgaaaatgatgattcctcttccaatcaaaaggtattttatggccattctttggctaaattcctcagaaggcatcatgttgaaaactattcattctatgagaatgcaagctctccatttataataaaaagatgcccttacgacccttataagcatcatggagatgacaatggaagaatcatgaaaaactgcagagacaatggatactatcacgaaagcgcagatggagcttgctacttatgcaggctagaaggaaagtcaggatgtgaccattatggctttgaaacatttataaatcctcaaaagaccaatgaaaccggaggtgtcagtgcctgcggct

SEQ ID NO: 1152 - DNA, 1024 bp, Methanobrevibacter ruminantium
gtgattgaaatgataaaactagttaatgagctaaaaatagaccaaaaaggcttaatgtactcctcagaattgattctgtccctcatattgattatattcatcataggaatcatggccaatataacagacagcgtcaatgaaaaggtccttagccaagaggagctttcctccctagaggccataagcatagaaagtgtagattatctattgaacaatcctggaagtccaatgaattgggaggaagatgaaggattgaataatggaattgtatcaagacgaatcataccaggacttgccataaataaaaaatctgtggaaaatggctttttttatgaagaaagcagtagtgatgaagagataatacctaactccatatcatatatcaagctcttaaagcttcaatctaactatgatgacttgatcaatcggaatctatttaattcgactcttaaaagttcaataactatttatccccactctgatattgatataatagctatgggagatgatttagaatcatctagtgatgttgtggctataaatagaacagttagatgtgactatcttagcaattttgtgatatataggttcaatgactttgagctttatggtgagaattataaaaaaaccgaactctgcaatcatgacagcaatgttaatctatctaatcatagcaatgatcgaaggtatttttggctttgcaagaactttagaatctatagaagttctctaaataactataattattacttgatttctgattcgtcaataaggcatgcaaatagttattatatactggaaagccttaacagaacaagggatgatatggaaagattaaatgatgaggtgattgaattaaatccgttctttgctgaagatatggtaaatagctctaatgagatttattcaattcattttaaggttccacatgatgatattgatgattttaaaacggttatggtagctatccataagaatatgactgatgagattgtatccaataatcagttgagatatgattatt

SEQ ID NO: 1153 - DNA, 1024 bp, Methanobrevibacter ruminantium
atgctagttaaaaagatgcttagagacttatctgaccataagattcaatttgtatccatcttccttatggcctttttaggcgtattcgcctttacaggaataaatggagaagtggttggaatcacagatgtgtcaacacactactatgaagacacaaatcttgcagatggttggatatatggcgagaactttgataaggatactctaaaagatataaagaacatggaagaggtcaagaatgcccatagggagatggtagttgatacggtagccaactactcttcggacccagacataactctccatatactggaaggaaagcaagagatatccaaattccatctgtttaagggaaaagactttaatcctaacgacaaggaaggaatatggattgacaagcgctttgcagatgcaagagacctagatattggagataagatatcccttaaatttgatggaaagacagtgtctaagaccatccgaggaattatatactctccagaatatgtctactacatccaggaaggaagcatgatacctgacttcagccaagtgggctatgcattcatgccaagtaagggagctgattttgacatagagtacaatagaattacaatagacggcaagaaggaacttgacgctaaggagttcagcagtgaggtatcagagcttttaggccaatacacctatgcccaattcgttccaagggaagacaatgtaggggtaagcacattgcaggatgagatagaccagcataatatgttttcaggaattttcccaattatctttgttatggtggcccttttaacccttttaaccacaatgagcagggtgatttcttcacagagaacacagattggaacactgaaggctatgggatatgacaatactacaatcattctccattatctctcatatggattcttcctatcctttgcaggctctcttttaggccttataataggtcctctcacccttccatatctcttctatccaagcatgtcagcaatgtattcacttccat

SEQ ID NO: 1154 - DNA, 1024 bp, Methanobrevibacter ruminantium
atgaagatgatacgtcaattcggggaatcctccatcgctcttgtcgtcaatctaatactgtttttatttaatggaattaaatacatatttacccttcctaatcgtatttatgtctatataaagctatttttagaagatactgatgcagtattaaaggaaagcctgattgctctttctatctgtgctgtaggggatttatgtgcaggtatcattttaggaaatatggaattcttcctaaagacctatcccggccttatggtaatcattccaggtgcaataggaatgaggggaaacatctttggctcttttggctcaaggcttagcacacaccttcacattggtactttgtctcctgaatttaaaagatcagagatacttagcgaaaacattacagcatcccttattttgactatggtactatccatattgcttgctgtaatcgctaaaggagtctgcatagcctttggatttaaaagcataagcatttatgactttgttcttatttcatttattgcagggcttatttcaactatcattatgctgcctattacaatgtttatctcacttaagagctttgaaggaggctgggacccagacaatattacaactccattcattgcagctgttggagactttttcacccttccagcaatcatattaagcgtaatcatagtgggattcatttccataatccctatagtcaagatgattgtctttgtagcggtaatatttgttacaatagcagcattgattgcaggatacacagcaaaaagcgatgtaaggcatattgtaaggcaatccactcctgtactattcatttgctcactccttggaacatttgcaggtggaatattgaatgattctcttacaaccttgcttaagaatcagactttactcactcttgttccactcttctcaggtgaaagcggaggattggtaagcatattaggagcaaggctatcatctggccttcactcaggtcttattgacccagtgctcagacctaagaagcatacagtagaga

SEQ ID NO: 1155 - DNA, 993 bp, Methanobrevibacter ruminantium
atgttacttacaatcttgctattttcacttgcagtagatcttcttctaggtgagtttccaatgcagatacatcctgtagtatggattggaaaaataataagcttttttaagaatatcctaatcaaatacgacaataagatagctggattgattctctcaattgctgtaataattgtttcatcacttattgttctaattccaatggctatagcaaggtatctattgccatataatgatatgatgatttatctattcaagctgatagcgattttgcttcttacttcaacattttcagtcaagctgttgttggattctgcccgtgatgttgaaaaggacttaaggaacaataacttaaataaggcacgtcaggccgttagctatctggttagccgtgacactaatgaattgaataaggagcatgtcatatccgctgtaatagagactctaagtgaaaacatacctgactcctatgtttcaactgtattctactattcaattgttggaataatagctagcctatgtggaattggagactttgatgtcataatacttgctgttcttgctgcatttatccatagggttgttgatacaatggattccatggtaggatacaagactaaggaactctacaatatcggttttattccagcgcatttggatgatgctttaaattacatacctgcaaggttttctggagctttgattgttgtatctgctatgtttctacgtttaaattggaaaaatgcattgtttattatgagaagggatgcaaacaattgtgacagtcctaattcaggatatacgatggcaacagtagctggagcattaaacattcagctagaaaaggaaggagtttataccttaggggataatataaatccaataaatgttgattgcattgaaaaggcagtggatctagcaagactgaccatatttttagttacaatattcttcatgtttgtatttatggatttaattcttttaatgctttaa

SEQ ID NO: 1156 - DNA, 1024 bp, Methanobrevibacter ruminantium
atgcttaaaagaaagatgctaagagatatttggaattataaagttcaatttatatccattttcataattgcattcataggcgtatttgtatttgccggactgactgcagaggcagatggttttgaagcctccatagactcattttaccagaggagcaatttagctgacggatggatatactcaaactatcttgttgatgactttctaaagcaggtctacttgcttggcgcaaccactagtatggagagacagttggttgtagattcccaagctgaattagatggcaagcccgatattacgctgcattttgttgaaaacaacaccatatctaaatattatcctcttgaaggcaatgaattaaatataagcgattctgaaggtgtatggttagataaaactttcgctgatgctcgaaatctgaagataggggacaccattgcatttgaaagcaatggaattaaaatagaaaagaagattaggggattaggctattctccagagaatgtttatagcttagttcccactcaaacagttccaaattatacggcaaggggctttgcttatatgtcctataaggcatttccatcagacaatataacttataatgttcttaatgttaagtttgatggacgccctgaaatcttctcagagctattgtcctatcgtttagatggatattatgaattgtatctgccccaatcaaatcaatatagcgtaaatgcggtttcagattcaatcgctcatcaaagttcattaaacgctgttttcccaattcttttcactttgatttcaatgctgatgctttcagtgactatgaaaagaatcatctctaatcaaagaactcaaatcggtgttcttaaggctaatggatttagcaataggtcaatagctatccattatatgtcctttggctttttattagtcacatcagggtcaatattaggtgcaattttagggccgatcgtattccatttcgttgttcatgaatccagaatttattattttaagttccctgtttgggctt

SEQ ID NO: 1157 - DNA, 1024 bp, Methanobrevibacter ruminantium
atgaatcaaaatgcccagtggaattcaattataacatttatattggcaatgattggccttaccataggcatagggaatatttggcgtttcagctatgtattatactctaatggaggaggatccttcttcataccttattttattgcaataatggttatgggaattcctttcttgattttagagtatggattaggctttagcctaaagaagagtttttcaaagctgatgcatgatatacgcccggaatttgaggtaattgcttggatgttggtcatattcgtattcatcgttgtaatttactatatggttatcataggctgggattttgtatatttcctaaacagctttagcttcggttggggaagcgatcccaattcattcttcatgacttatgttggtggaactagggagatatcccagattggaaggcttcttcttcctacattaatttgcacaacagtcttatggattattttttggtttgtatccaatcgtgatgtggatgaaggaatcggaaagatttcaaccattctaatgcctttgctatttataataatgatttttatctttttatactcattcacattgccaggatttgacattggaataaagacattgcttaagcctaattggtctcttcttttagacattcacatctggcttgcagcattcggacagacaatattcaccttaagcataggccaggcaatggtctatacctatgcaagctatttgcctaggaattccaaattggtcgatgaagtattgcttgtggttattacaaacaccttatatgaggttttcattgccattggggtcttttcaatacttggatatatgtccctaaagtcatcaatacctatagaaaaactaatcagtgaaggaactggactgatatttgttgtatttccaaagatatttagtgagatgggttttgtaggtcagattataggtccattgctatttttatcaatactatttgcaggatttacttccgcattggcattgtttgagcctttcctat

SEQ ID NO: 1158 - DNA, 507 bp, Methanobrevibacter ruminantium
atgaataaaaaattgattgaatatttgattatagcaacagttattattttaatcctttatggttgctattctcttattgattatcaatccaacggatatcagtttcgtatggtgaatgctactgattcaatgaatatatcttgtccttcaagttctgcctattcagtcagtggagacacagtagaatttagaaatggattaaacagtttctataatatggacgttagcaagctaaactcttcagatggtaaagttaaaaatatattgaatcaatattctaagttccataagtccggtactttagatttaaaaaatgagacttgctatgtgctgacagtagaattggaagacgataaaggatttaattatcattccatgattatctctgtcgattcatttgataaggatagtttatcctttaataaggaagcaaccgtttatctatttgatggaaacaatagggaatttgttgtagatactgtatatggaagtcaggtggtaatatga

SEQ ID NO: 1159 - DNA, 939 bp, Methanobrevibacter ruminantium
atgagtccatatgaactgataaaggatgatggtgaagtggttaatcttggtggttctcctgatgagagtcaagattttgatgtttctttagaaaggctaaatgataaatctttagcagattcagatggcgatggaaagcatgacgtattcatcagctattcaactaaaaactcagatatagcaaatgagatatgctaccttcttgaaaagaacggtcttgaatgctggattgctccaagaaacatttcatctggcaaaaattatgttgatgagatagcagatggaatcaaatcaactaaaatagtcgttttagtattttcaaaatattcacaggaatccaaatatgtaaacaatgaagttatgatggcattcagctataataagcctattatttcatttaatattgatcaaacagagcctaatgacattatgggatattatttaaaggtggctcaatggctgccggcatatccaaatcctaaaagtcagtatgagacattggttactgacgctttaaaattatgcaatgaaaggccaagaactgtaattacaagcttagacggcttcattccagaagacatatccaagcaaaagaaaaattggatatcacttatattgctgtttactccaatctattgggcttcatttatttatatgggccttgtttcaaagaaaaaatcatggacattgttaggatttttatatgcgattccaacagtaatcggattgcttttgtatttccaggtatttaccagattattccttatttatccgatatttaggttatttaatttaatatttatattatgctggatattggccataattcatggattggttattagaaatgagtttttaaccagatattctgttttaggactgatgtcttttgataaggatctctttgagtatctttatggtatgtattataaaatgtaa

SEQ ID NO: 1160 - DNA, 876 bp, Methanobrevibacter ruminantium
atgagtcatgatgtttttatatgctatgatgaggaagataaagattgtgcagaggccatttgccgtatctttgaagagaataatattaagacttggattcgctcaagagacgtatcttcaaaggatgcagcccgcaatctaacagaggctataagaaattccaaatgttttgtattggtctattcaaagaatggaaagaacaccaattatattataaatgaaacagacatagcattttcaaaagaaattccaattatactctttaagcttgatgagacaagcattccaaaggatttggaatttattttaataagcaaaaagaagatagtggcatatcctcatagcaaaagacaattaaagactcttgtaaaagagacttcagatatattagatagaccaacagatgatattaagcttgattctaattcagtcaagacaattgaaaggtctaatcctaaaagaaaggaaaacaatataaagaaagctattggagcagcggctttaatagcagcagttttaattttaatttatttatttgtaatagtgcctacaggccagaacatcaccgatagcggtgtattctccatggatgtaacccatgttgaagtggatgaattggccaaaggcaataagtatacgatatatggcgaatcatataatttgccaagtgattctgatagatactttatgaaccttcaattctttgatgataaggataatgtggtttatgaggtaaattcaacagccgatgagtttaaatcaggcattatatggagtggtgatataaataaaggtgatattaagcatattgggtttaaattaactgatatggataataaaatactctcccaagaggattataatcttggattgtag

SEQ ID NO: 1161 - DNA, 810 bp, Methanobrevibacter ruminantium
atgggtttgttaagcctcaccatttcctattttaacaaatccgcaaatggagaatcattatgggcgccatttttagaaatgtttagaatgctttctgtagtcttgattctaacatacatagccaccaaatccaaaagttttaaagttataatcagaggccaacagtcccgtaaaaccataatctggcagattatcatattttccattctaggaattcttgcatcatattgcactatggatgtaaatggaatccctgcaaatgcaagaggattgattgtaatgatatccgcattgcttggaggaccatatgttggaatacctgtaggaataatagccggagtctggagatatggcatgggaggcattactgccttggcatgtggcgttgcaacaataatggctggaattgtaggaagtctcgtttatagatggaacgatggcgaattcctaaggccatataaggctgcacttttaatgcttctatatagcggctttgacatgtttctaataaccatattaacccctcaaccaaagggagttcttattgctaatgccctttatgctccaatgacatttggcgctgttcttggaatcttactcttcaccctatttttaactgagaaaaaagaggaagccgaaaaaagcgatgaacaaactgtttctgacaataggaatacagacacacagaatataaatgaaatctcacaagaattgaatgaatataaagataaagttaaaaagttagaacagaaactagaggaatacgacaaaaaatttaatcaattggaacagaaattaaaggacaaataa

SEQ ID NO: 1162 - DNA, 1024 bp, Methanobrevibacter ruminantium
atgaatgaaaccattaaggagcactcttggattcccttaatccttgtttgttttgctacctttatcatagctttggatacaacattcatgaacgtcagcatttcctcagttgttgctgacttgaacactgatgtgagtaccattcaaacaatctcatcattctatactctcatcactgcctcattcatgctcttaagtaccaagcttcaggatatagttggtaaaaagaagctctttttaatcggtgctggaatttatggcgtcggtaccttgactgcagcattaagtgccaatactctaatgttatttataggatgggcattgctggaaggtataggcggtgcattgatgacacctactgcagtttccatcataagcggaacctatcagggtgaaaagcttacattcgcccttgcaattgaaagcgcactggttgcaattgcagcagctatcggcccgctcttcggtggggtcgttacaacatacttcacttggagattaggatttgcagtggaatttataatcgtcctgatcgtatttgcactgcagggcaaaataccttatttcgaagctacaggatccaaaagcgaattggacattacaggtgctataatctcatttgtaggtcttgtcctctttgttatgggtattttgatgctaactgatgataccactttcagcatagctataatggctgcaggattaattgttctagcactctttgcactctttgaaatcaaaagaaaaagaaaaggcaacgtaccgttgcttgatgttgaattattaaaagacagaaatctccgtgtaggtactctccttaggctgttggttaaccttgcaatgggcggtgcattgtttgcagtctcagtctatctgcaaagcgtattggccttatctgcattcaacacaggtttgaccttgcttccaatgaccttaggtttgcttctctttgcattgacagccccaaagctatctgcaaaactgaaccacaagatcctcatgtcaataggatgtataatatcaa

SEQ ID NO: 1163 - DNA, 675 bp, Methanobrevibacter ruminantium
ttgaaggaagatacggcctctaatgaagagattcgctcccgccttttagatggaggcaaaatcacaggaacaaacatgcgcgttctggtatgtgctatggtgattgcatctgtagggcttaacatgagctcaactgcagtaatcatcggtgccatgctgatttcacctctgatgggaagcattcttgcctctgcctatgcaagcgtgaccaatgaccgtccccttcttggaaagcatttaaccggatttgcaatgcagattataataagcgtaactgcagcagccatcttctttttcctctctccagttaaggagccaacagtagagctattggctagaacatctccttcattttatgatgtgttaatcgcattcttcggaggacttgcaggaatcataggacagaccaggtcagataaggtaagcacagttatcccaggggtagctattgcaacagcccttatgcctcctctatgtacctgcggttattcaattgcaaacggaagatgggacatgcttctaggagcaggttatttgtttttaattaactgctatttcatattcctctcatcaagccttattttaagtgcattgaagattccaaaattgaaggagtatacagaaaaagaatggaaaatccataagtggagaatgagttacggaatactattttaa

SEQ ID NO: 1164 - DNA, 1024 bp, Methanobrevibacter ruminantium
atgagagacattgaagaacttaaaaagacaccaggactgtcacttaaaagatatcttattctttttattgcaaatcttatcggattgtatctaatcagctttggattggatttcaccgtcaccaatctaggcagagtcataatattcatatttttcataagcatcttcaatgcagcaatatggcctctggtaacaaggatatacatgccccttatggtttggacctttggaatcggagcactccttttaaacggaggggtctttgccttcttcggcccatactttggcttagacatatcaggatggggaatagtccttgccccattaacaattgcccttattacaatcgtcctatcaacccttatggacgctgaggatgatggcacatattatcaggctgttcttagagaagcccaaactaaaagaaaaggagagattaaggattatcctgggctaatcattgttgaaatcgatgggcttgcatatgacgtgctcttggaagctgtagagaaaggagtcatgccaactgtcaagtcaatgattgacaacaaaacccatatccttaaaaaatgggagactgacctctcctctcaaaccggagccagccaagcaggtatcctacatggaaacaatgaaaacatcaccgccttcagatggattgaaaaggaaaacaacaatcagatgatgcagtgctctggagttacaaaggtaaaggttcttgaagagagaatatcagacggtaacggcttgcttgttgaaaatggggcaagcagatcaaacctcttttcaggggatacagacaatgtcatatttaccttcagcaaaataacagaccttagaaagctttacaatggcgcttggttttcaatcttttcaaatccaagcgaattcgcacgtatagtaattttagtcatagaagacatggtccatgagatctattcccaacttaagcacagcatactaaatatccgtccaagaatctcaaggggcatcgcatatattccaacaagggccggaacaaatg

SEQ ID NO: 1165 - DNA, 1024 bp, Methanobrevibacter ruminantium
atgttagccccagatttaggattaatatatgttttaggattactattcggcccatatggtgctttaggtgtcgcattggcaatcgtgacattaaatttaataaacggattcacacttatggaaacactgccctttgaaatattcacctttggagtctcatatttaggatacaggctttggtactctggatttaaaaccgatacaattacaaagccaaaactagataacagctaccacatctccctatttttagtaagcatcatcatctgtggatttatctattcaacagtccaaggaatctcttttaaccttatattctgggttgatagattttatataatgatcctcttttatttcatgagctttaccacaatggcatttctctatggaataataggcatttggatctgcaacagatatgattgtttcgaaacaccaaaaaaatcaaaaagacatgttgacaagagaatatatcaggcaatattctgcatgataatcatcacatcaataatcctagccacatcatttataactactgatgatacaacggtgcgaatcatagagttgatagttttgggaatcttcctatttgcctatctgacaaagccattcgaatatgatataacaccgaatgacaaggatacaatcagcggaaggataatgcggaatttcattataatcacatttatccttggagttttgggaatagcaatttccatgatcagctacagtgcatatagtcaaagcgataacgtctacttagtattaatgtggggacctataataaccgatacggtattgctcctgttcctcattccttgcatttttatcttaagatatattgaagacaaagtagttcagcctatctcatcattttccaaaatcgaaggattcattaaggaaaatgagaagattgatgaagacggattggtaaagacctattccaagtataccgatgagaagacagagattggaacacttgcccgctcatataccgaactgataaagcacaataacaactata

SEQ ID NO: 1166 - DNA, 1024 bp, Methanobrevibacter ruminantium
atggcaggtaacatatgcctatttgttgatggtttgattgtaagttttttaattggagccagtaatcttgctcctattcagattgtagctccagtaatcacatttgtcaatcttatttattggatgatcggattgggaggaagcgtcctatgttctgttgcaaaggcagaatttgatgatgaaaaaagcaatagctacttttcagtatcaatcatatccctcatatccatcggggtattgattacggttataggactcttgttttcaggaagcattgcccagttcctatgctcttcacagcctgaattggtttcacaagtgtcccaatatttcattgcattggttattggaatgccattcttatgttatatgatgagcttatcttatttcataagggcggatggtatcccccaactgccattcagggctatacttatagcaaatattgtcaatatttgctttgacattatttacattaagtttttcaatttgggcctaacaggggcggcgcttgctacctcaaccggttatcttgtaggttccattttaatttcatattacttctttaaaaaggaacgtactttggaatttataaaattgaaagctaacgctttctttaaattcattaaaaagatagttacttcaggattttcttctgcgtcaactcaactctatctgactttaaaattgcttgtcataaactttttagttggcctttacgttggaaagtcaggggttgtcgcattcggaatttgttataacagtctgttcatactatacatattcctgattggaactgcacagacaatgtctccaatcgtatctgtttactttaaggaggaagactattctggagttgactatattataaagaggtcccttaagatagtggttgcttcaagtttggctctgtctgttttattcatattctatcctcaggccttgcttttcttgtatagtgttaaagacccggcagatgttcctgtagtattgaatgcattgagaatttttgcaataagttatg

SEQ ID NO: 1167 - DNA, 1024 bp, Methanobrevibacter ruminantium
atgtttaacaactataaagacaaactgaccggagatagaaagatcctaatattgtttgtaatattagccatctttaacatagccttatacatcaacatattcaagtatatggttgacatcaaggacataaacatggcggtcatacacgactttgtcacaatcaactgtgcaatcataatcctaggatttacttcaaccaggctccccaatcttaaaaagcgtgacagttcaatttatgaaataagctatcttatcatcataggcctattaagcataaccatttcattctttaacaagtccatcaatggggaatcattatgggctccctatttggaaatgttcaggatcctatctgtcgtcctgattttaacattcctagccactaaaaccaaaagctttaaggccgtagtaaggggagaccgctcccgaaagacaatcatctcacagataatcctatgttcagtccttggaatccttgcatcatatttcacaatggacatcaacggccttccagccaatgcaagagcattggttgtaatgatatccggattgcttggagggccatatattggaatacctgtaggaataatctctggagtctggagatattcaatgggaggtcctacagcattggcatgcgccattgcaacaattctagccggaatcactggaagcatcatccacagatggaatgggaatgaattcatatccccagtcaaggcagggcttttaatgtttttttacagcggctttgagatgtttctgcttaccatattgaccccaagaccaactggactcatcgttgcaagcaatctttatggcccgatgacatttgcagcagtccttggaatcctactattcagcctatttttagatgagaaaaaagagaaagctgaaaccgatactgatgatggagatgaagataaaaagatagaactaatgtcggaagaattggaagaatataaaataaaagccaaccaaaccgaaggggaactaaaagagtataaagataaggttgaaaagc

SEQ ID NO: 1168 - DNA, 609 bp, Methanobrevibacter ruminantium
atggaaactaaaaacctaatcataatatgtgttacattaattattcttgtatgccttggcctatttctcatatcccatatgaacggtcaggaagaaacccatataaccattctaacaagccaataccttacagaaggagacacattaaaactaaagctatgcgataaggatggaaagggaatagccgatcaaaagattagcttaaagatccaatcaaaggatggaaactttaatgacgatatagtcattaaaacagatgagaatggtgaaagccaaattcaaaacctgcaaaggggaaattatactctcatagccaaatacgatggaacaagccaatatgaaggctatggattaacctatgaattcattgtaagccctaaggaagttgagcaaagctctaaaaccactagcacaactacaactgccacatccaataatggagattatgcgagtgactataaggcagatgatgttatagatggttgggatccttcagaacatgaggtttctagagagtatttaggagagggtgagtatagagtcaattatgatgatggatattctagagtgattgacagtgatggaaatgttttaagctatggatattag

SEQ ID NO: 1169 - DNA, 111 bp, Methanobrevibacter ruminantium
gtgctttataggggctataaaaaaggaatggagtttggaaagttccagtatgcatttattgtttgcttaagtgccctgtttatttgcttgctttatagcctatttaattaa

SEQ ID NO: 1170 - DNA, 711 bp, Methanobrevibacter ruminantium
atgttaaaaaaattaaagattattatagttggtgataggatggacaataaactatttttacaggcatttagcaaatttttcattggcctaattataatatgcgcacttctttttattcccgctggaactctcaactacccgaacggatggctatttatagcattactcttcatcccaatgttttttgctggaatcatcatgtttatcaaaagtccagagcttctaagaagacgattgaatgctgatgaagaggaagaagagcaaaaaatagtgatcttaattagcgcaatcatctttcttcttgcttttattcttgcagggctaaactttagattcggatggtttaagctcaatagcttgattataatcattgcttcagtcatatttctccttgcatatatcatgtatgcagaggttcttagggagaatgaatacctctctcgaacagtagaagtgaatgagggtcaaaatgtggttgacacaggactctatggcattgtgcgtcatcctatgtacacttccacaatattcctgtttctatcaatgccattggtattggatagcatattttcatttatagtcatgctgatttatccaataatcataatctttagaataaaaaacgaagaaaagcttttagaagaagagcttgatggatatgtggagtatgaaaaaagggtaaaatatagattaataccatatttgtggtag

SEQ ID NO: 1171 - DNA, 984 bp, Methanobrevibacter ruminantium; identical to SEQ ID NO: 974

SEQ ID NO: 1172 - DNA, 897 bp, Methanobrevibacter ruminantium; identical to SEQ ID NO: 975

SEQ ID NO: 1173 - DNA, 1024 bp, Methanobrevibacter ruminantium; identical to SEQ ID NO: 976

SEQ ID NO: 1174 - DNA, 918 bp, Methanobrevibacter ruminantium
atgttgattgctatggactttagaataattatactctcaataatcataatgattctgcttggagtgcttcttaaaaaaatagaccttctaaaagaagaagatgtcgaaacactcaataatttagtaatcaatatatgtctaccttgtctaattttcaatgctttatacactgctgatgtttccttgcttccatctttgagtattttaacactttccactactatcactagtttaatcgtaggagtattcacttatattctacttaaattatttgcttgggataatgttaaaatatggagcatacttgtaacagtggtcttgggaaatacagggtttttaggctatccgattacacaggggatctatggcagcgaaggccttatacgtgcagtcttctgtgactgctccacctcaatcacatttgtaatattgagcgttatcctgatattgatttttgatggtgaattgaaggtggctttaagaaagatagctacttttgttccattatggtctatcgttttaggaattctctttaatatattcgccattccgataacagatgtcggaactactgtagttggttatttgggtgatgccactatccctcttattatgatctctttaggcttgtccttgaatataagcgggcttaagaacaatcttaaggaagtgagtcttgcctcattcattaagcttatattatatccctttgtggctttaggggttatggccttgcttggaatcactggattcaatcatacaatcggacttattgaagcggctatgtcatcagctatgattgggcttgttttagccataacttataagttggatcctcatttgacttcagattgtatttttacttcgactttgtttggcttagtgactattcctttgtttttaatgtttatagtttaa

SEQ ID NO: 1175 - DNA, 1024 bp, Methanobrevibacter ruminantium
atgaacggaatatattattatgtaatagcctttctacttatttggactattgcaattgtatttaagggcagacttgaaaattatggccttgaagtcaattttccccttttgatgtggaagacacagagattgagaggatttatagacagaatcgccaatagggctccacggttttggaaatggtacatgaatataggaatcgtcatctctactggatttatgattctgatggctgtggccttggtatattctcttaagaccctgatggacgctcctacagtcagcctggttattccaggggtggaagtgccaggatctccaatattcattcctttcctatctggtcttatagcccttgcaacagttcttatagttcatgagttcagtcatggaatattggcaagggtggagaaaatcaagattaattcaataggtcttctattatttgcaattcttccaggagcttttgtagagcctgatgaagaggaattgaagggattgaaccgtccttctagaatgagaatatatgttgcaggttccatggctaatctgaccttggcagctattgctcttgttatcatgatgctcatatcctcctttgtagtccctgcagtctttgaggatgacggcattgtaataagcaggctcactgaagacggcaatgcaatcaattatctctctgagggaatggtgataaagggaataaacaattattccgtaagcgatggggcatcctatcaaaaggctgtaagcacattaaggcctaatcaaacggtgactgttctaacggatcagggagagtatagcttccaattgaagtcaaatcctcaaaacaagtctttaggatatatgggagttcaggcacaggttaatcaaataatttctccggattttgataataagttctacactcctttattatggggaataatgtctttgacagacttattgttctggatatacttcttgaactttgctgtcggcacattcaacctgcttccaatgaagccattggatggaggtc

SEQ ID NO: 1176 - DNA, 1024 bp, Methanobrevibacter ruminantium
atgaaattcgattcagagacatctgtattgcttgtatcattccttacagcattctttgcagtgtttttagctgcaggtatagtcataggagttccagcaattgcaaatgagtttggaatgaacaatgtagttcaaaattggattattacaatcgcattgcttgttgtagctatgtttacgcttcctgctggacagttgtccggtaagttcggtgtcaaaaggtctttgcttgttggagtattaatctttatcgtcggttcaataggagcatgccttgctttttctgccgaatcattcctcttctttagggtgattcaaggaatcggaggggcattttcaaatgtggcttctatggctatggtcgttcaggcaatcaagccacaaagcagaggaaaggcccttgggcttactgtaactggggtttaccttgcaggatccctttctcctgtaatatgcggattccttgtttataactttggatggagatccatgttttactttacaattccattcttccttatttgtattgcgctaatgctttggaagattccaggggattggaaaacctatgaaaatgataagattgactctataggatacatgatttatgcagtgggaatattgctcttcatctatggatttacaaacttgataaacgcttggggtttgatttgtgttgttgtaggctttatattgcttcttgcctttgcatattatgaaacaagagtggacactcctgcatttaacatgagattgtttaagaatactaagtttgcatcctccaatgttgcggcattatgcagctatcttgcagttgcagcactcactaccatattgaattatcatttccagtatgtaaggggatggaacgctcaaatgtctgggcttatattgattgttacccctataatcatggcatttatggctccaaactccggtaaattgtctgataggatacatcctcaaaaattggcagctattggaatgaccattgcaactgcagccctagtgattttgatattct

SEQ ID NO: 1177 - DNA, 1024 bp, Methanobrevibacter ruminantium
atgaaattagatttagaaacagttgtagtggcggtatcgtttattacttcattttttgcagtatttttatcaaatggaattgtcataggggttccagctattgcacaagagtttgcaatgaataatgttattcaaaactgggttcctacaatattcttccttgtggtagctatatttacagttcctgcagggcagatatcaggtaagtttggtgttaagaagtctttgcttggaggagtgcttgtctacctctttgcttcaataggggctgtgctttcattctctactgagtcattcctccttttccgtatccttcagggtgcaggggttgcattcttgaatgtgtctgctatggctatggttgtacatgcagttaagcctcaaaataggggaaaggcacttggatttacagtgactggggtttatttggctacatcattgtctcctgtaatttgcggattccttgttcataatctcggctggagatcaatgttctactttgtaattcctttccttgttatttgcgttcttcttatggcatttaaaatacctggagaatggaagacatatgaaaaggacaagatcgatatgatcggatccattctatatggaatcggaatattggcattcatctatggatttacaaccttaacaacaagcacaggtcttatcctaaccattgcaggacttgccatgcttgttgtatttggagcttatgagctaagacagaagtctcctgtattcaatatgaacctatttaaaaataagaagttcacatcttcaaatatagcagcattgtgcagctatattgccgttatggtggttacaacaatcttgaattatcatttccagtatgtaaggggatggaatgctcagactgcaggtatgatattgattatcactccaattatcatggcaataatggctccaaactctggaaagctttcagataagatacatcctcagaaactggctgcaataggcatgtcaattgctactgtggctcttcttattctcacattcc

SEQ ID NO: 1178 - DNA, 858 bp, Methanobrevibacter ruminantium
atgctctttgtagagattttaaagaatctgtctgtttttgaaatattggttcgtaagctattgaaaaaagtaaaaaataccagaggactggttctatttttagtcttcacctgcttttttagctccatattcattacaaatgatgtttcattgattatatttgtaccatttacaatattggccttaagaaaggttgatagacttgatttgataatatttgcagtgtctatggagacaattgcagctaatgttggctgtatggttcttcctattggggctccacataatattgtaatgtatatggtttctcatattccattccagtcatttttcttgattcttttgccttatatcgttgtatctgcagtgtttttgattattctatccttctttgttccaagcgatgcagtaaacttgcctaaatttggcaaagttgagattaataaggaaggcttctttaaaagagtcttatttggtgttgattatttccttcttttgactttcatagcactatttgtattgataggaaacttggaaaacattacattctttaatctgttgtttaaaaagtggataataggcaatgaggttatttggggcgtagtggcatctcagtttatttcaaatgttcctgctgcaatcttgctcagtggattcagcactaattatgaggcgataattgttggaatcaatattggagggcttggaactcttattgcgtctatggcaaatcttatttcatataagattcttgtgagggagcatggggagtttaaaatcagatatttgattatatttacatttttaaatgtggttctgctctttatcctattgggagtttatgtttttattcattaa

SEQ ID NO: 1179 - DNA, 252 bp, Methanobrevibacter ruminantium
atgtggttaatcatttttgggaatatagagaacttgattttatcttcccaaggagttgtacagggagtggatcctaagattttaggtggattaagtattcttgtagttattatgtggtttgtaatcggtacagtcattactgatgttgcaatacaatattccaatcttattaattttattggcggtcttgcaatatttcttttaggttttcaagctgtttatgaggctgttaggaacataaggggtggataa

SEQ ID NO: 1180 - DNA, 270 bp, Methanobrevibacter ruminantium
atggattggaaaccttatgctccattcactgcattgcttatttttggaaacattgaaaaccttattctatcatctgaaggtgtaatagcaggtgttaattcatttgttttgcttatattgagtttgatagccgttgttgcttggcttctcttaggaacatatggtacaaactatgcaatcaagtatgctgattatattgaaattatcggcggaatcgctattattctattgggtttagaatcaatgcttgaagcctttggaattctttaa

SEQ ID NO: 1181 - DNA, 645 bp, Methanobrevibacter ruminantium
atggaaataaaaagaatcaacaggtatgtcatttacctattttcactgtttttaatatcattaggggcctcaatatcaatcaaggcaaatctgggaacatctccaatcatctgccttccatatgtttcaagccttatcttgaatatgagcgttggaacagtctgtttgatatttaatgttatattcatacttgttcagataatcctccttaggggagactttgaaaggagacagtatcttcagataattgtaggaacaatcttctccctttcaattgacttttcaatgacgcttgtaacttttttaaatcctacaaactacattagccagtttgccgtccttatgctaagttgtgtggttgttgcatttggcgtattgcttgaggttcaaacagaggtggtctttcttcctcccgatggaatcattgtggctatttcaaaggttctaaataaggagtttcctaaggtaaaacctttctttgatacatcattagtgcttacagcagctattctttcaatagttttcctaggctaccttgcaggagtccgtgaaggaaccataatttcagctgtaataattgggcctatcgttaaagtgcttcagaagttctttaatccttatatcgaggctgtaattgaaaaataa

SEQ ID NO: 1182 - DNA, 462 bp, Methanobrevibacter ruminantium
atgaatttcgaattctccattcttggattgtttttattattgctcctatttgttccaaacataatctggactaaatttatccctaaagattatgaaaattattcaaagagagaaaataagatattgttaatccttgaacgtattggtgaagtggcaactgttgtatttgccttgttttgcggtgctaaatttagctggtcattattattaattattatttttattctaatggctttgtatgaggtttattggattagatactttatgtcaagccatacaatgaaggatatgtgtgatagtcttttaatgattccccttccaggtgccacattgcctgtaattgcattctttttgtttggaatctattcaaatagcatatttttagttatatcttcaattattttggcaattggacatattggtattcattataatcataaaaagcagtgtaatcttaattaa

SEQ ID NO: 1183 - DNA, 1024 bp, Methanobrevibacter ruminantium
atgtctaattcgcaaaatgatggtttagaagatgtttccaagggaaacaatgaatctgctggtgaaaatacagattcaacttctaataaaaaaactagatttactaaatctaaatctatttcagaggtttttaaggaattagattctcaggaaaccaatgattccatcttagattctgaagatgctgcttctgaattagaatctgaagataaatattctaatatagaaaattatctttccgaggcagaatctgaagaagaaattttagatgcttcttctgaggcagaatctttagatgctagttctgatgtagaatttgaagaggatattattatcgattctactgcagaagaagaaatagatgaaattattcctattcataatgaatataaggatttagatgaatctgaagctttcaatacagaatctattgatgaagaagaaatttcagaatcttctgaattggataattatgttgaaagcattgttaatgaaaaagatgacttaagctctgatgaacttgtcgattctaaagaaaacttagatgctgtcggtggagatgaaggctctatgagcgttaaagatatcgaaaacgcttcatttgaagctgaagatacctcattagatgctgaagattacgaagatgactctattgacagtgaggatatcgatcaatcttatgaagaagagcttcttgatgagaatatgaaagttataaaggtaaataatgcttcttcagaggatgttttatcaaagaaaaataaaggattccttagctctttcgggtctataaaaatggattcttcctttattatcacagttcttagtttcattgttggactgggaattttaatcatgggtatattctatctcaactccagttctgatagagttgtagataatgttttatctggtgaaactgcaggtcttgcagtctttttaattatcattggtcttttaattatcggtttcagtattttaagattcctttcttctacaaaggccgatcagtcttcttctatgc

SEQ ID NO: 1184 - DNA, 618 bp, Methanobrevibacter ruminantium
atggagataatgcctattatttcattttttataggggtaatttcaatattatctccttgcattctgcctaccttgccaataattgcaggatttagcctaaaagccgaatcaaaagcagaaatagtggccttcatattagggctatttagcatattcacaatcattatattcctgacaggattctttacaactattctttttaggtatattgtttatgtaagggtcattgccgcatttcttttgctcattatgggaatattgatgttttttgactataatctatcttttggatcggttaagtctcgtagtggtgagggaatagtcaattcatttattttaggatttcttacatcagtggcttgggcagattgctatagcggatatctcatttctcttataactatgcttgtatcaagcagtcctttatatgcagtttttaatattttcatttatgtttttggctttgcattgaccttgcttgtattgtgcttggccatttcaaaaatagatctagagaagctgatttataagtcaggctatattcctaagatatttgctgttttaattattattggggctttttatatgttttacacttcaattcaagtgtttttataa

SEQ ID NO: 1185 - DNA, 1024 bp, Methanobrevibacter ruminantium
ttggaacgtatcatcggagttgatgaaactgccaaaacgccagcatatgaattagaggatggggtcgattatgtccctatgaataaatacagggcattattggttcattttcttaatattgcaggtttaggtcctattttcggagctattcaaggcgcattattcggaccttctgcattcttatggatcgttttaggtactatctttgctggtggagtccacgatttcttcgaaggggcaatgtctgttcgaaatgacggtctatccatgcctggaataataagcaaatatttgggagatagggttcgcaagttctttgccgttttaataattataacatgcattcttgtggcatctgtttttgcatctggctcagcagatttgctttcaagtttaacaaatatagatattcatatttggctcgttgcaatattcatatatttcctcatagccacattattcccagttgataagattataggtaagatttatccaattttcggagctttgttttttataatggctgttttgcttatttctgcattgatattaaatccaaattattcattgccagaatttacaactgcagggctttatttaactgacaaagccattttcccattcctatttgtaaccattgcttgcggtgcaatctccggattccatgcatcccaagcgccaattgttgcaagatgcgttaaaaatgaaaaggatatgcatatggtattctatggtgcaatggttattgaaggaatacttgcattaatttgggcaactattgccatgtcatttttccatggacagcctcaattagccagtatttatggatccagcccttccattgcagttaaagaaatgtcaatagcattgattggtactgtaggattggttttggcaatcattggtgttgtaatatgtccaatcacatcaggggacacttcccttcgtagtgcaagaataacaattgcagatgaattaggtttaaatcaggataaactaaagactagacttaagatatccattc

SEQ ID NO: 1186 - DNA, 462 bp, Methanobrevibacter ruminantium
atgttaagtttaattaaagacaataaaggctttttatctcttatagatgctattttatctatttttctaatttttatagttctaatctcatttaatatgattgtagatatggagatgcctagcttatccgaagacaacaatcaattcaagacaagtcaagatcttatggagctgatgtcttcaaagatagatggcagggattattccacattggagcgaatctcatatgttttatcctccaatgataattcgatagcctcaagaagggaagttaagaatattctagatgatttctttagcgctcatctgggttctgactataaatatgtttttatagagactaatcaattaaatggctatgtcttgtcatctgatggtgattattcaactgctgatgaggtttctctagctataagaaactatggaaattattcttataagctttatattttcaaggcttaa

SEQ ID NO: 1187 - DNA, 1024 bp, Methanobrevibacter ruminantium
atggaagaacgtactggacttttttcaaatggagttatctggttcggagttgcaatctctgtctcagaaatagaggcaggaatacagcttgcttccatgaacacccttgattccatttggctacctttagtccttggccacatcataggaggcatactgctattttctacaggacttataggtgcacgtcttagattgaatgcaatggagaccatcaaatcaacctttggcaattatggctccaaattcttttccacattaaatgtattgcagcttatagcttgggtagctgtgctgaatgcacaaggggcttcagcattgatgggcttgaatttacccatatccttccctttaacctgcattatcctgtctgcaatcattgcagtatgggtttatgtaggacttagaaggtcatctaagattactaccattatgatgatagtgcttacagcattgctggttattctatctgtaaaactcttaggggtccatatatccaatgctttgcctattcaaaacattaattcaacagcattaagcttttggagcatctttgaaatttcaatagctatgccaatctcatggcttcctgtgatttcagattataccaaagatgtggaaaacccagtaaacggcacattggtctctgcaatagcatataccatagcaagcctttggatgtattttttaggcatagaaatagttggcattggaacaacaagcattgcacaatcaatcctccttgcaggtcttggagctcaaggagtgataattttagtgctttcaactgtaacctccaattttgtagctgcaaattcagcaggggaatcagcaaaggccatctttaatagaatcaatccaaagattgcaggagttgtagtgagtgcaataagtgcaatacttgcaatatctggaattatggatcattatattggattcttatatcttattgcatctgtatttgctcctatggctgcagtgctccttgtatctttctatctttcaaaggaagagactggaaatg

SEQ ID NO: 1188 - DNA, 843 bp, Methanobrevibacter ruminantium
atgaatgaaacaataaaaaccttaacaattcaagacatatcctgttatggacaatgctccatcacagttgcattacccgtaatttctgcttttggaatagaaacagcaatcctcccttctgctgtactctcaacacacacttcaggttttactgattttactgttagagatttaacagaagatcttccagaaatccgtaaacattgggaaaaagaaggaatatttttcgattcaatttacactggattcattgcatcagcagaacagttagattacataaaagacatcatagactcaagattaaaagaaaatggccttgtatttgttgaccctgccatggcagaccatggagaattctataatggatttgaccaagaatttgcagataaaatgggagagctttgtaaattaggtgatttcattctccctaacacaactgaagcatgctttatcctacataagccttggaaagaaagctttacaaaagaagaaatgctagagatggctaaagagcttaaagcattcactaaaagatatgtcatattaaagggatatgaagaagaagacaagatgggaatgatcgttttagataaaatagaagacactattgatatagtttacaatgaaaagataaattatgtatcccatggaactggagatgtatttgcttcatcatttgtaggatcaaccatgttaggtaagtccccttcagcagcagcaaagatagccggagaatttactaaaaaggcaattgaaaagaccattggcgatgagactcatacttatggagttaaattcgaacaggcaattccagagttgtatgatctgttaaaatcaatataa

SEQ ID NO: 1189 - DNA, 678 bp, Methanobrevibacter ruminantium
atgatggactggtcccctatttttatctcaatgaaaaccgcaagcctatcaatctttataacctttttcttaggtttgattgtagcttggcttctcgttaagataaaaaatgacactacaaaaattgtactggatggcattttcacacttccaattgtattgccacctacagtagtagggtttttcctgctttatatttttggtatcagaggacctataggaagcttctttttagacttctttgctgtaaagatagcattttcatggcctgcaactgttatagctgcagtggttatgtcttttcctttaatgtatcgttctgctagaggtgcatttaaacaagttgattccaatttattggatgccggccgtacattaggtatgtctgagtggaagatcttttggaaaatcttatttgcaaatgctttgcctggaatcataagtggcggaattcttgcttatgcccgtggcttaggagaattcggtgctaccgcaatgcttgccggaaacattgccggacaaactagaacactccctatggcggtttactctgaagtggctgctggaaatatgggaactgcctttgattatgttatattcatagtggccatatcatttatagcgatttttattatggactatttttccatacgcaaggaaaaccaatggaaaaactag

SEQ ID NO: 1190 - DNA, 1024 bp, Methanobrevibacter ruminantium
atggctcaaaaagaattggatattcctgtagatggcatgcattgttcctcttgttcccttctagttgaaaagtcgctaggtaagcttgatgaagtggaatccatcaatgtggacctaaacaccaataaggcccatatggtgttaaaggataatctctctccagaaacaatcgataagacagttgaatctgtgggatttaccgttccaaaggaggaagtggtcattcagattgctggaatgcattgtgcctcttgcgtgaacaatgttgaaaagttccttcctcgtgtagatggtgtggttgaggcaaatgccaatctttccaatcagaaggttaccatcacatactatagggacatgctcaatctaaaggagattcaaaagacaatcgaaatgcttggattcgaatatatcggccttgacggcgaactggacataatggatgaagaggaaaggtatcaaaaggaccttagaggcaaactatatagaatcatagtaggtctggtctttgccggtatacttatggcaattatgcatttccatattacaattcctccattgactatgggacaactctctttaatcatagctattttcccattctgttatgtaagcatgcctatcttaaaggctggatggaactccttcaagcataagaacctagatatggatgtaatgtattcaatgggtattcttgtggcatttgtatcaagcgtattaggtacattcaatataattctcgactcaagttttatgttctatgaatctgcagtgatgttgccttcattcctcactataggacgttatcttgaggcaagagcaaaaaggaaaacctcatcatcaatcaaggagcttattggccttcagccaaaaacagcaacattaattacaagtgatgaagagggcaatagcatagaaaaggaaatagatattgaggatatcaatattggagacatattgcttgtaaagcctggtgaaaagatacctgcagactctattgtagttgacggtgaaagctatgttgatg

SEQ ID NO: 1191 - DNA, 1024 bp, Methanobrevibacter ruminantium
atgatcggcataggggcaatactgctatttcctctgccaatcgacttattctatagagaattcaattatgtttatggagtaattccgcctttaatttcaatcatattaggagttattttttctcaaggattcagagaatatgacaaacttaaattcaagcatgggatgatcatatcaagcatatcatggctatgggcaggtcttgttggagcaataatcatgatgctgattttagatgtctcattcgtagacgctttttttgaaaatatctctgcatggaccggaagcggattgaccatgttcagcgatgttgaatccttgcctatgtcaatactatttttaagaagtgtggaacaatggatcggtggacttggagtggtaatcatcttcataagcctactcattaagcctggaacttctgcattcaagctatacaagtctgaagcaagggaagatagaataaagccaaatataaaaaatacccttaaaaaaacaatgcagatatatgccatttataccgttataggggtcatcttatatcttatagcaggacttcccctctttgattccataaatctgacattcactacaatatccgccggaggaatgtcaataaagaatgcaaatatcggattctaccaaaatgatattgtttatataatcactatctttctaatgatattaggggctacaagctttacagtccattataaaatggctaaaacaaaaggaaaagccatattaaaggatatacaattccaactattgattgtaagcatcatacttagtgcaatagcaattgcaatcattacaaaacttgctcctatggatgtggttttccatgtcgtttctgcaattacaacaacaggagcaaacattgcccctccaagtgagatggcagcatgggctccccctgcactgataatcataatagtcttgatgctgatgggtggttcttcaggttccactgtaggtgctataaagcttgttagagtaattacactcttaaaaagcacacatcttg

SEQ ID NO: 1192 - DNA, 1024 bp, Methanobrevibacter ruminantium
atgggctcattggacacaggaataattggacctgtccttccctcaatcgaacagagcttccatctgacaagccgagaatcaagctggatatttacattatttgtaatcacattcatgattggttctccagtaatggccaaattttcagacttctatggaagaaaaaagatattcatccttgacgttcttctttttggaataggatcttgcctaatagcagcatccataagcatagaattaatatttttaggcagactcatacaaggattcggctgtggaggaatattcccagtagcgggggcatttgtaggagacggattcccattggaagagagaggaaaggcattgggaattcttggaagcgtatttggaatatcagcaataggagggcctcttgtaggagcagcattaatcccctatggctggaactggtgttttacaataaacattccaattgcaatatttctaattatctttgcatggtacatactgccagactcagataacgatagaaaactaaagatagactatttaggaatactaatattaagcttgctagccatattcttatcctacgggcttaatcaaatagactcaagcaattttatagcgagcctactctctctaaatgtacttccattcttagtaatattcataattctaatcccaatattcctaaaggtagagaaaaaagccgaagagtcaatcgtgccaatccatatgctaaagaataaggaaatatcaattgcatgcatagaaaccttatgctatggaataatctactcttcagcaattttcataccatcactggtaatcctttcaatgggattggacgaccagcttgcaagccttatgctgattccaatacttggagcaaatgcagttgcagcaccgattcttggaaaaatcctggataaaacaggctcaaagaagcttatggcaatgggaacaatgattcttgcaatagggcttattgcaattgcaatctatccaagcaatctaatattcttcataatagccggat

SEQ ID NO: 1193 - DNA, 1024 bp, Methanobrevibacter ruminantium
atggcaaatgaaaatgtagagctaatgagaggagcaccggagatagcagttaagaaactggcaattccaatcatgatttccatgctcctaaccgcatcatataacataatcgatggaatattcgtagcaggcttaggccaggcagcaattgccggaataggctttgtaaccccaatattcatgatactaaacggtgtaagcgtaggtcttggaagcggtgcaacaagcagcataagtcgttttgtaggggctaaaaaccacgaaggagcaaacaagtcagccacccatgccctattgatattccttatagcctcaataatcctaacaatcatattcctcttcatccaagaacctctccttagaacatatggagcaagcggacaatctctagctgaaggactaaaatacggaagccccctatttctaggactcttcacattcatgtttgcaaatggaggaagcggaattctccgtggagaaggggacatgaaaagggcaatgtatgcagtaattgtatctgtaatattaaacacatgccttgaccctatcttcatctacacattaggtatgggctcagcaggagcttcccttgcaactatagtcagctctgcaggttcagccatagtcataatgtattggatacttataaagaaagacacttgggtccatgtggagctaaagaacttcaagttcgattcaaatatagcaaaggacattctaaaagtaggaattcctgcttcaatggacatgttcatgatgtcactagctgtcagtctttatctaatattcatctcaacaataggaggagaattcggcatagctgcattcacatcaggtcaaaggctatacctatttgcaataatgcctctaacatcaataggaagcgcagtggcagcagtagcaggaagcgcctatggagcaagaaacggagattacctatcaagaacacatatttacggcgctaagtttggaatagcctttggaacagcagttacaataatccttatagcctttgctccacagc

SEQ ID NO: 1194 - DNA, 1024 bp, Methanobrevibacter ruminantium
atgaatatttcaagtttattttcagatgaaaaagttaatacaggaagacaagtcgaactggatatcgctaaggcatttgcaatcatatttatgatttttttacatactgtcatgatagttgaagcatataatgtcggcttaagcccaacttatacttatataatcggcaatgtcttaggaaggccttatgctgcagtcgtcttcatgttctgcatgggagtcggtgtggtatattcaaggcacagccaatggaacttgatgattaaaagaggaattatcctatatctcttaggccttttggtaaatgtctttgagttcttcttacctcattatcttgccggataccttggcgttaatgctgaggctttccctctatttggaggactaataatcttttgtgttgacatcttggcatttgcaggtttggcatttatccttatgggaatcctaaggaaattcgaagtttcaaataaagctatgattataattgcagttataatgtctctaatcggcagtttcacaataggaattgactttggaatccctgcagtatgctcattcttcggtcacttcattggagctaaaaacggacataccgcatttcctttattcaattggtttatcttcccagttgcgggatacgtctggggacagtatttcatcagagccaaggacaaaagggaattctttaaatactggccgatcctattgattgtggcttttgcttacttcttcatatcctcacgctattggggaggagtcttttcagaggatgttcacttatattactttttaaacacattggatgcagtattctgcataataaatgcccacgcattcatcggattatgctattggatttcagattatctgccagattcaattaccaagttcttttcaacactaagccgcaatattaatgaaatttatattgcacaatggttctatatacctgtaacaataatcttaatcacttatttctccaaaggattagtatttgatgatttggtaactacaatagttt

SEQ ID NO: 1195 - DNA, 1024 bp, Methanobrevibacter ruminantium
atgtatttaattagcttttttggattaggagttaaattaaccaatttcaatgatgttgcactattcatcatatttgtaagtctaatcaatgcaatcttatggcctatactcaccagaatcctaatgccatttctcgttttatcatttggaatagggacacttattctaaatggcctattattaaacttctgcggaccccttttcggcataaatgtggaaggccctgcaataattttagctccactagcaatgtcctttgttacaacagccctatctacaatattaaccattgaagatgaaggatcctattacaggtcagtctatagggatgctgaaaagaaaagaaaaggggaagtgaaagattatccgggactcataatcgttgagattgacggtcttgcatatgacgtcttaaaggaagcggttgataagggatatatgcctaccctcaaatcaatgattgataatacacataccctaagaatgtgggagacagacctatcctcacaaacaggggcaagccaggcagggatactgcatggaaataatgaagacatcaccgcattcagatggattgaaaagaaaaacaacaatcagatgatgcaatgctctggagtgactcaagtaacaacattggaagagagaatttcagatggaaatgggcttcttgtagataatggagccagcagatccaatctcttctccggtgatacagacaatgtaatatttacattcagcaaaatcctaaacatccgaaaactatacaacaaggcatggttttcagtattctcaaatcctagcaactttgcccgtatagtatgcctgtttatttacgacatgaccttggaaatcatatcccaaataaagcacagcgtaaagaacatcaggcctagaatcaaacgtggcatagcctatattccaacaagagctgcaaccaatgttttcatgagggaaatcaacacctcaacattgattggagacatgatggtcggcgacattgacgttgcatattcaacctatttag

SEQ ID NO: 1196 - DNA, 714 bp, Methanobrevibacter ruminantium
atggatataagtgaaataattggagatgcaattgcatatcctatacataatattaaagctttagtaatttatatgattattggaatcattactggaatcttaggtggcgcaagtttcatgggcttacttatgagcctaacaggcaaaaacgctcttgctgctggaggatttggtatccttggagtattagttctcctcattggagcattattaattacaggatatggtttggatattgtaaaatttggtattgaaagaagagatgacggtcctggaattgacttagtaagacaagttttaaatgcagttaaattacttattgtcagcattgtttactacattgtccctgcaattattgcttgggtattgtttactctcttaggtaggggtatattaactgtacttattgttatgataatttctattatcttcgcatttgctgaatttatggcaatatgcagattagctaaatatgatagtttaggagaagctttagcaatcggtgaagctattggtgacatatcaaaagtaggtgtaataaaacttctcgcaactattattatagtagttgtcattgcaatgatcgtatgctttatcttattatacgtttataaattaaatagcctcattggaggaattttattgggtatatttgctgtatacctaacattcttcgccaatagggcagctggtttattatactctgatgcataa

SEQ ID NO: 1197 - DNA, 813 bp, Methanobrevibacter ruminantium
atgaatatggatttcagcgtaaaggattttaatgtacggctccggacaatacgtatttgggaagtagtcatagctcttgttgtagcattctttttaaccggatttacatgcgattattttggaatctactctggagaggcagagtatatcatattcttcttgtatatgatggtcttctttgcaatagcctccatcgggacacatgggtttaaagatgacatatacggtgtattcaaggcctccaatctgtttaaggtcattatgatagtcataccaaatatgctcttggctttctttatacagcagcatcttgctggttttgatgctatgtttaataatatcaatttattagctcttccagtttcagatttggcttatgaggcttcaaatcctctcttgttcctttttgaattcttttcagcaatcttcattgcgcctatttcagaggagctcttctttagaggaatcttattcaataggcttaagataagaaaaggagttatatttggagtggtggtatcttcaatcatctttggattatgccatttcaattatccagaccatttggctcatataatttacacttgcctatttggaatgtgcttatgcattctctatttgagaacagacaatctattgataaacatgtttgcacacttcctctataatctattgtcttatgtgatagtatacactccaataggggatctcttcttaggaggtccgtttatggatttcactgtcatagtcttgttgttttcaatagtatttgttccggcgtatatattttatttctctataaagctgaaatga

SEQ ID NO: 1198 - DNA, 804 bp, Methanobrevibacter ruminantium
atggattttaatgtaacagacttcaatgttagattaagaacaattaagcttagggaattattagtaggtattgtcattgcttttattttatccatagccctcttaatcatatttccagttatggatagttatgatgatttggctttgatggtttttgtattcttcttattcattttcttcctttatgctttaaaaggtacctctggtctaaaacaggatttcaataaactatttgaaagggacaacagtcgtgaaattctttatgtgctcattatcaatatgttgtttgcttttttagtcttggctatattttccactttcgatgcataccttactttagctgattcggagtgggtttctatccttgattttactcctactgctattgatcctgcagtttttctatttgaatctttcacttccattataatcgctccaattcttgaagaattggtctttaggggagttttattcaataggttaaagattagaacaggcattcttccggctatgttaatctcttcattcctatttgcaataggtcatgaattcggcggaatgacaagtgcatttgtatttggaatgtgtatgtgtgttctttatcttaaaacagataatatattaatgggcatgtctgttcatttcctgaacaatcttatatttacagtatgggacttatttgcattggatgcaattgttttccaaatgcctgtattgccattgactttactcatttccattatttctggattattaataattctttatttatataaggagattggtaaattactggctgaatag

SEQ ID NO: 1199 - DNA, 630 bp, Methanobrevibacter ruminantium
  modified_base (11)..(11): a, c, t, g, unknown or other
atgttcttganttacggctattcctacagggttacaaaggtctctgtagaagggatgattaacggtaacgatccattgccagaatttgatgatgtgattggcatgtttgttgacggcataaaggtttgcctggtctatctgggatatgcgctggttccaataataatattcatggtctttgctttagtctccagcgctattggaggatatggcgaatctgtattgatggcatttggctctattattactcttctagccataatcggcgcttatgtgatgagcatgtttggagttgcaaacatggctaattacgacggcgcattggcaaaggcatttgacattaaggagattattgaaatcatacagtccgtcggcgttgtaagaagcgtaggggcatatattggattggctattatttgcactgcaatctttatgattgttggactattgctcttctttgtattcggattctttggaataatcactggaaccttagggtcctatactgcagcaggaggcatattcattgcaggaattatcttaggttacttcttaatgctattcattgtaagtccttatattttgattatgcaatcaagagttgctggattattatataaccttcattaa

SEQ ID NO: 1200 - DNA, 849 bp, Methanobrevibacter ruminantium
atggctagcattacagacattataaaggaaggacttaaatatccattcaatgacactagaaaggtattgattcttgggctaatattcctcatctctgggctcatttcccttttcacacagtatgtggtttatgattccatgacccttatggtcaatgcctccccatatacctcagttaatggaatgtttgcatcaattcctccatctaattcagctttaattttcctgtcatggattgtaacattcattttgttccttttcacttcaggatacatatatgatgttattaaatatgcaatagatggaagatacgaacttccagactttggcaatatatttgcaatccttaagaacggattacgcacattaattgttggaattgtttattccattgtgccagctcttatattcatccttggattgatgctgatggttaatgaggcttcaggtgaagctgtaaacatgtttggacttatattgctttttgtttcatttattgttgcaatattcatttatcttattgaagtcattgcaatctcacatatggttgaaaatgacagtcttaagtctgcattccaatttagtgagatctttgatataatttcaaatatgggctggggaagatttatcggagccttgatatttgctttcattgtaattgcaataatttcaatgttctttggaatgatattcggagcaatatctactggaattggcatattgttcgattctgcattggtttcaactcttgttagttctatattgactggtttgttattaagtccatatatcagtattgctttaggcagaatgtttggatctgtttataaggaggctattagtgagtaa

SEQ ID NO: 1201 - DNA, 105 bp, Methanobrevibacter ruminantium
ttggacatgatttcaatccttaaaattttaattgctttgatttttgagatgattttagaagtttttgaaatgattttagatagttttagaaattattataggtag

SEQ ID NO: 1202 - DNA, 720 bp, Methanobrevibacter ruminantium
atgcttctattttttatttataaatttaattctatctctaaaaagaattctagttcaaattttaattataattcaagttcgaatagggattctaattcagtaaataactcttctctttcagatgcttttagaaacgatttaaacagcatattcaaggtttctaagatttatcacattctatttattgttttagcaaacatactatttgtatctgcaatatactttgtattaagttatttgggatccatatccattattcagtttaatgcccctttattcggtgatttcactggtttaggctttgatgtaacgctcctttaccttataactgtagttatcctatctccaataatcgaagagtttctctttagaggaatcttcttacgaagattcaatcttgagcttgacaatttgacacttgctatcttgatttcctcagtcttatttggaatttgtcataactttggaggaatattgggagctattctctttggaatctgcgtttccattctttatgtcaagtccaggaatgtattagtccctattttggctcatttcattaacaatctcatttcctttttgctggcccttattggaatagagaatttcattcatggaaatagcattgtcattgctttaataatcattttggccattataagtaattttgtgctctttagagctattgtattagagtggcctaaatcttttaaagaatag

SEQ ID NO: 1203 - DNA, 606 bp, Methanobrevibacter ruminantium
atgttaaaatttactggaaaagaaataagagatttaataatatcattcattgtaattgctttggcattctctattctttattcaaatcgtgattttaatggaattctattcatatttccaatagttgcaataggagtaggtgccggattcatctttcatgaattagggcataagtttgcagctatgcactatggatattgggcagaatatcaattatggccaactggacttgtcattgcattggtaagttcctttttcggattcatctttgcagctccaggagcagttgtcatatacagtcaaggaatggaaaagtctgagaatggtttggtttcacttgcaggtcctgcagtcaatatagtccttggattgatctttttaggtattttaaattcattaggtcaggtcactgattataatggctatatcatagctttgatttgcttgcttggaactagaattaatttcttcttggcaacatttaacttattgcctatcccaccattggatggatctaaagttttatcttggaatgctcttgtttggatagttgcatttgccatatctgttatattgcttgttgtctatggcggttaccttggatag

SEQ ID NO: 1204 - DNA, 162 bp, Methanobrevibacter ruminantium
atggcaaagaaagatgataaatacagtatgcctatgagtggggcaggtttagtaagatactttgatgacgaaagtgtaggtccaaagatagctccagaatacgttattgctttaacagttattctcggtatcttttgtttcattttaagatactccatataa

SEQ ID NO: 1205 - DNA, 1024 bp, Methanobrevibacter ruminantium
ttggatgcattaagggcattagcaattatctgcgtaattgccatacatgcttacgcatgctcaaggaattttgttattagcgaattggtgggaaacttaccttcattgaattggattattattcaattttcaggcaatacatttagaataggagtagatttgtttttaatgttgtctggtgctttatctttaggtagggattggaagatgaaggacttctttgctcatagattccctagaatagtatatccatttttattttggagcatcctcttaggaaccatatttcttctattgtcatattatgattcatttaatgtgataagctcatttgatttggtttcaatagccaattacttctatggagtatttatgggaattattgatttcgctaagccttattggtacttttggatgattttagggatttatctgataatgcctgtatttaacaaatggattttgcattctgatttggatgatcttctttatttcttattcttctggcttataacatgcttgtttgactatacattaggagttgaatttccaatcagattgtcatactttacaagtccgataggtttggtggttttaggctattatttaagatatacaaggagaataattctaaataaccaatattttgcattatttttgattattttctcaagcctattgatgcttgtcctttcggccatttattcaacagacactcatttctataattttaatatatattccattttagtcagcatggaagttataggagtgttcttattgtttaagaatttctataagtttaatttaaatatagggttcttctcaaggcctgatggattctttaataaatcagtttatgctttggccaggtatagttatggcatatttctgattcataatgcatttatatgtgtgttggtgcactacttgggcaatacaggcattccgccagtcttatatatgattatattgtttgttgtttctttactctgttcggtgattgtaatggctgtattaagta

SEQ ID NO: 1206 - DNA, 1024 bp, Methanobrevibacter ruminantium
atgagtgaaaattcttccttttctgtggataatctggttatttatctgctgctaatagcattgccaatctttttgttctttgtatcatttatgttaggtagatatcctgtggcacctatagatgttataaagaccattctaagtcctatatttccatctttggctgtgtctcctgaattgaattccatcgtctttacaataaggctgcctaggattatagcggctttgcttgttggtgctgccttatctatagctggagcttcatttcagggaatatttaaaaaccctcttgtctctcctgatcttttaggagtatctatgggagcaggttttggagcggccattgctattttagcaaatgctggaaatgctttgattcaactttctgcctttgtctttggtcttattgcagtattcattacattttcaatatcaaagacatataaggccggaggaattttactccttgtgctctctggtactgcagtctctgcattcttcaatgcattgatttcaggagccaaatttatggcagatccttatgataaattgcctcagattacctattggcttatgggcagtctctctgcagttaattttgataagctggcaatgataatcattccattggtgctgggaataattgtcgtcatgattttaagatggcatttgaatgtcctctctatgggtgatgaggaagcccaatcattgggattgaacccatcaagacttagattgattgttattattgcctgtactttagtaacatctgctgcagtttcaatcagtggaattatagggtggataggtcttgttgttcctcatatgactcgtataattgtaggtccagaccataagatacttattccagcttcattaagcataggggcaagtttcctattgctcattgacaatatttcaagaactttcatatcaattgaaattcctattggtattttaactgcaattattggtgttcctttattcctttacttgcttagaaaaggctattctgagtggaatt

SEQ ID NO: 1207 - DNA, 162 bp, Methanobrevibacter ruminantium
atgagcatgcttgcagacttcgagcctgcaaggctccacaagaggacatgggctgaaaggcatgatgtcgaaatccttgctgtcatatgccttgccataagcattgcaatgctacttcttttctttgcgcttgcagagccgactgttgcaggagtgatttag

SEQ ID NO: 1208 - DNA, 198 bp, Methanobrevibacter ruminantium
gtggctatcctattgccattgatgagcatgttaggaatcggagaattgactcagaactacatattggcaatagtgagcggtatgatagcccttgtggtttggtactacaacgagaagcacaacagcgatttggtgagcggaaccaccaagtgcgactgcgagctttgctatgggggagacgatgaagcacttatatga

SEQ ID NO: 1209 - DNA, 258 bp, Methanobrevibacter ruminantium
atgataaccactggcgtagtgatattgttcaacagcataaccgagcacccttacttcatggagtgggacgagataggaatcgttcttggaatcgtttccatcaccatcgcctgcatttacatagcgatgatagacagatggaaggaacgcaggaagaaggaggagcttgacacgatagaggactacataaacaggaaggctgaggagatagcgaacatgaaggtattgaggaaacttgaggaattggaagaggaatga

SEQ ID NO: 1210 - DNA, 534 bp, Methanobrevibacter ruminantium
ttgggattttggggattgacaaccgattgcggaaatctcctgttcccgttaggataccttatggcagacgtgattacagaagtctatggagagaggacagctcgaagggtcatattgcttgggctctttgcaaacatattgctgattgtggctaccacattgactgtctacatgccgtatccaagctattggacaggacagggagcgtatgcctacatgttcggattcactcctagaatcgtgcttgcagggttcatagcatacttggtgggacagttcgtgaatgcgagacttatggtgctcatcaagaaatggaccaacagcaagtacctgttcatgaggacaatcggatctacacttggaggggagctttgtgatagttgcatatgcagcagcattgcttattacggtattgtgcctaactctggcatattgctatttattcttatgcagtatgttgttaaggttacttgggaagtggtgatgcagcctctgacatacaagtcaatcgcttgggctagaaaagacggatag

SEQ ID NO: 1211 - DNA, 546 bp, Methanobrevibacter ruminantium
ttgaaggctattggagataacttctcagtggattatctccttttagcattattctctagtggagatttgatattggttgccatcgttctcaattcttatggtgtcatctcacctgagaatgtaagggaactggtgattgactatataagttacaggaaagttgatattttttggagacatctaaggagacctagaatgagttttgaagattatgtcttagacaattttgaagagatggaaactggtgaactcaccagagagcaggttgttgaatttgtctctcgacaagagaggaaaggactcaccttctgcaatgagatcttcattgctgtgcctttgaagaaggggagcaaggacgatatcgttgagatattgtggaatgagtattttgtggaggactataaggagaactggttagagcaacacgagaatcttggttggaatgactggaagaaacttttgaagaaagagatagttgagaatggtggcgatgacttccaaatctttaggaatcacctgattgactgtgtcttaatggagtattga

SEQ ID NO: 1212 - DNA, 570 bp, Methanobrevibacter ruminantium
atggagaaagtagaacaattaacaatagaaaaaattgaaagagaacgagaaagaactgaacaatttgaaagagctattaaagaagcaaaggaacaatttgaaagagaaagaactgaacaatttgaaagagaaagaaaggaaagactagaaagagaaaagagagaaaaagaaagagaaaagatagaaaaagaaagagaaagaaaggaaagactagaaagaaataggattaaaatagaagaaagagaaagagaaagaataaaaagaaatgaaagaattagaagagagaatgaaagaaataggattaaaagtgataagagagaaagagaaaagagtgaagaaaaaagaataaaaaggaatgaaagaattaggaaagcaaatgaaagaaatagtattaaaagagaaaagagagaaagagaaagagaaagaaacgtgatgactattgatgaatattacaggtcaataggatacgggtcaacaggaaaaagtaaggtatggtcagcaattattattccaatattattggttatatgtattatattgattttaatgttttatggaggaggaatgtga

SEQ ID NO: 1213 - DNA, 1024 bp, Methanobrevibacter ruminantium
atgctgaagacaaacttcggaatcaccaaggacacccttactgaccttggatggagtggtgccgctgacgatgtcaagggctatcaggaggcattggacaaggctcttgagaagggtggagacatggacggaatgctcgacaccacaacaggacaccttgagacattgaagaagaacttccgtgttgcaggaaggcatgtgggagagatgttcactccatacatagacatggcagtccagaaactgaatggcttgaaggagacatgtcctggcttgtttgagaaccttgtcatgatagcgggtgcagtgagcggatttgccactgtggctccaagcattgctcctatgataagcgtctttggagatgtgggaagtgcgataaagaggacagcaggattcttgggactgatggaggttgcagaggacgcagtaaccttgaagtcaacattcctgacaatagctcagattgcaggcgctgacgcagctgtgcttcagactgccgcaaacagcggtttgactgcaagcttctgggcaatggctgctgcaatcttggctaaccctttgacttgggttgcagttgcacttatagccattgcagtagcagtctatgaggtcggaaagagtttcggatggtggtctgatataggctccatgattggtgctgtttgggcaggaatccaaaggctttggagcgccttcataaacaatcctaacgtgcaaggattcctgaaggacctgtctaacgcatggaatgacatatgcgaggcattggcaccagtcatcgattgggctaggaaggcttgggctgagctgttccctcctagcgccacaggaagctttgacattgtcagggcgataattgacgttttcggacagttgggagacttcttaggcaaggttgtgaatgccgtaaaatctgcttggaacgcattgggaggatttgccggattccttcctatgctgttgggacctgtaggaatggttgtcatggctttgagaatgattgtctgcatacttttaggtt

SEQ ID NO: 1214 - DNA, 681 bp, Methanobrevibacter ruminantium
atggatttaatttttgaatatctgattgtttttattttattatttgccacaaatatagcatttttactaagatattctagttttaataaaaataaatttattccatttgttttaggctatgctattatagtatttgcattaacttttgtattttcttccttgaatttacaaaaggaatccatagattttattccgtatattttatttgctgttagtgctttaatgctaattatttcaattcgatatgtgggatttggaaagaattatggaataaatgatgataaagttgttttatatggcactattttatcttcattcttatctattggggcattggctttaggtttaaaatcagataatcttttcttatctggtcttgaattagctattctttctgttgtagttatctttttagtttataaaatctcaaaaatattcaacaatgctaaaagaccatattatgcagtcattggtgaatatatgtttttagaatttattttgcttcttattttagctttaaccttctctagcgtaagagaattggattattcaatgtttggatcttttctaattcttactcctacatataaggtgctatatatgattatagcaattgtcattttgcttgttttaggggttttatataatgattgggttttaaaaaggctaaaaaggaagtaa

SEQ ID NO: 1215 - DNA, 642 bp, Methanobrevibacter ruminantium
atgatacttcaaggtacggaaatattgacttcgtttatccatattgtttctgaaagcttgctggcacctgttgtaattgttttagttatattcttaatctatgcaattttaagctttggcggatttttaaatgaatggtttacaaaaaagccattgaaatctgcaggattggaaaagttattgcaagacatttcaagctccgatagtcctgaagacttaaaggctgttatagatgccagcgctttgtataaagagcaaaaagaaattcttgtaaagataactgataattataatttaggtccagaggcaagaaaggcttttgcaagtaaacttattgaagaggaagaaagcaatctgcttaaattaacaactaaaacagatattttagtaagattaggccctatatttggtcttcttggtactttaataccattaggtcctggactttctgctttaggtactggggatattaccactcttgcccaatccttgacaattgcttttgatacaactgtcactggtttgactattggtgcattaggttatattgtttctaaatatagaaagcaatggtatgaaagtgatttgactacaactgagacaattgcagaggctattttagaaaaattgaatcagttttaa

SEQ ID NO: 1216 - DNA, 318 bp, Methanobrevibacter ruminantium
atgttaagaaaaagaaaacgttttagtgatgatggcgatgaggatcctatgtctgggatttcaaatctttcagatgcaatgcttgtgcttgctttagggtttttgatttttgccattatggctcttcaggtaaatcctgatatgatggctaagactcaggagtctcaagcacaacaggccacttctcaagtgagcacaggtcaggactttaatagtagtgccaatgcaggtgcctctttagagcagtctggttattctgaggtgggaaaagtttataaagatcctgatactggtaaattagtcatggttcagggttga

SEQ ID NO: 1217 - DNA, 822 bp, Methanobrevibacter ruminantium
atgagttttaaaagtcctgcagatactgcaaaagcagttgcatctgcagctaccgcaaaaggtgaaatgcctatcataaaacttgctattttaggtttcttagcaggtgcatacattgcattcggaggtttacttgcagaagtagcaaatactggtgctattgctggtggagttccagtaggtatttctaaattattattcggggcagtgttccctgtaggtttaattatggttgttatctgtggatctgaattattcactggtgacgtaatgtttatgactatgggtcttttagacggtaaaactgatatcatgggcttactcaaaaactgggtaggtagttgggtattcaacttaatcggtggtctcttcgttgcttacgtacttgcttacttaactggtattatggtacctgaagcattcgctggcggtgcaattaccattgctaacactaaagcattaggtggagctaccttcatggcagctggtaaatcaactgcttctttaacttgggtacaatgtttccttagaggtatcggttgtaactggttagtatgtttagctgtatacttagctaacgctgctgacgatgtagtaggtaaattcttcggaatttggttcccaatcatggcgtttgtatgtattggatttgagcacagtgtcgcaaacatgttcttcatcccattaggtatcttcttaggtgctgaagtaacctgggcacaattcttcatcaacaacttaattcctgtaaccttaggtaacatcgttggtgctgctgtattcgtagcatgtgcttactggttcgtatacttacgcgactaa

SEQ ID NO: 1218 - DNA, 1024 bp, Methanobrevibacter ruminantium
atggctttaaacatagcttcagtcgttgatgcaagttttgtatcaacctttatcggacacaatgcacaggcggctttacaggtcttagagcctttggtattgttaattacaatatttgaatggctgtttggactgggaggtcaaattttagctttgaataaaaaggcggaatttgatgaaggtggaagcaatcattatttcacaactgcaatgcttgcaacaatagttctatcagttttgattttattggtatgctttttatttaaagattccttaattaatctattgcatccgactgctggagcactgccttatgtaaacgcatatagtccatatttattcatcagtttcccaattgcaactatcttgggagtattatgtcaatttattcgtgttgacgggcaaccgaattttgcttcaggagtaattattgttgcaaatattatcaatataattttagattatctcttccttggtgtttttcatatgggcattgaaggggcatcacttgcgatgatgataggttatgcagttggattattgtgtactttaaagtatcattttgattcaaaaagaactttccgattcgttttttccgaattgaaatttgggacttggatacgctcaacaattgaaataatcaagataggtcttccaggggcaagcatgggcttctttaatgtattgttgatctatatcatgaatttaattgttggcggagttttaggagagctgggcttggatatattcaatgtatgtgtggttgcattgcttttaataagcattttaatcatgggattcgccgaaacattatcttccattgttcctatttattatgcccaaaatgatttctataatcttcatcatattgtgcgaaattcaattataataacattggtctgttcggtgatattcactgcattcctcttaatatatcctgatggtctattgatgtttttcaaacttcaccaaaccgctaatgatggattagtggaaaatgcgattaggatatactcattggcat

SEQ ID NO: 1219 - DNA, 903 bp, Methanobrevibacter ruminantium
atgaatattataaaaaatctgcctttggcaataaccggattgatattggccattctttcacttggaaagatattcgctgatttcagcgccatattcttcataatcggctctattttaatatttatggtattgctaaagcttgtttttcatttcaatgactttttcaatgagctgaacaatctgattccattaagcacattcggtacattctcaatggctcttatgctttggagcacatatctaaagcccttattcctgccattgtcacaagatattgcctttgtgatatggattttaggaataataattcacctatccattattttgttctttacaaacaactatgtgcttaacaatttcaatattgaagatgtctatgcaacttggtggatcgtctatattggaattaccatggctgcaattacagctccagcccatggcctctcaaaatatggattcattttctttggaataggatttatattgatgataccaacattggttctggtctcctacagatacattaattttaaacaaatagacgatcaaaataagccattcatttgcatttatgctgcaattttatcaatccttattgtaggatacgtgaatgctatgacaataaacggcacttttctaagcattatctacataggggcagttattttttatatttttgcaataattcaagcattcaagtttataataattgaaagattgaagtttatgccaagcttttcagcctttacatttccatttgtaataagcgcaatagctacaggggaggcctataagttctttggacttgatattttgaattatctcttttatattcaagcgtttatagctttgattttagtaatatttgtattgtataattatttgaagtttttaatgaactag

SEQ ID NO: 1220 - DNA, 1024 bp, Methanobrevibacter ruminantium
atgaatgaacagacaaagctttctaaggatcattatatgatttttggcttaagttgggccggttgggtctttgatttctatgaccttgtcctatttacctttttgatttcacagcttcaatccagcttacatataaatgccgaaatgcttgcattatgcttaggattgtccctatttgctacaggattagggggaatcatttttggagcattaggtgataagtatggtcgtaagaaggtattggaatggacaattcttgtctattcgatagggacactgctatgtgcattctcatggtcattctattctctggttctattcagattcatcactggattgggagtcggaggagaatgggctacaggccaaatctatataagcgagacattccctgataatctaagggccaagtttggagctttcatgcaatcaggagctcctgttggagtcatattggcttcaatagtaggtggaatgataagccctattattggctggagaatgacatttttggtttccatcattccggcaatcaccattatccttattcgaagatatcttaaggaatccgatgtctggattaaaaataaggatgattttgtaaacaagaacatatttcaggagttcaagcaacttgtttcaaaggaatacagaaagatattccttatatccttggtattgtgcatattcggtatgtctgcatattggtttacctattcctggcttccaacctatctggcagaggagaggggccttgcaatggttacaacctcccttggaatcatactgattcagtgcggtgactttacaggatacacaacatttggttttgtagctgaaagaataggaaggcgtcctgcattcactatctacagtttcatcatgggaataagcattgcaatgataacaatatgctggaatcagatagataaggtcccagaccttataatggtattcatgttccttacaggattcggaacaggattctttggaggattcggttctctattctcagagctattcc

SEQ ID NO: 1221 - DNA, 1024 bp, Methanobrevibacter ruminantium
atggctaataatagtgtattaagacgtattgtttctctaattaccaagcataacatacttagtataggaactaagtattttcctactacagagcttgaaacagagtatgtagatatgttcaattatactcaaacaatgcttatggaaatcgataaagcgaatattactacagaaagtatcttcactaatctagttagagatgttggccgtgaaaatattccagaaaatcatagcttttatgaattgcttcccgctcaaaacaagatagatgaatatgccttagtaagcaagatcatcatgggaagtgacagatacatgtatgttgagctttcagagccttcctatatcatagattacttcacagacattatcttaagggaaaatggggagattattgaaagaagcgaaacagagattgtttcaagattgatgtctaaaaacgatgcaataagaatagccatcaagcttgtagggattggattggataataacattcgtgtaagggcagcagcaggaatgactggcgctgcagccattgaaagatcaatcaagttcaataaggaagttggagatgttccaggtgtggcattcaccaaattaggaggggaatatgcccttgttttagacactccatttaaattgggacaatctgaacatgcagaatatcagcattatctattcattgacatagtggattccactaatttcatatcaaagcatggtaaaaacaagcttgtagagcttatgaccagcgtcaaggagtttatggaaaactgtgaaggtcatattgaaggctaccgtgaaggtggagatgaccttattgctcgtttcccaagtaagggagtggcaattcgtgcaggccttgactgtgcatggttcattctaaataatggcgcaaaggtcaagataggtattggaagaagcagaagagaggcaggagaacgtgcaaacattgcagagggtattaaaggatttggggcattgactctaatcgtatttgatttggcaaacggattgtatgcat

SEQ ID NO: 1222 - DNA, 735 bp, Methanobrevibacter ruminantium
atgagaaaagtatttgaaagcatcatagaagctttaaagtatccattcagagattggaaaaatattattgtaattggctttcttctattaattgcttctttaggaaggaaattgccttttccagaggacccacagcagacagttgtttttataggtgcactcttaatactttttttgcaaacaggatacggttcaaaaatcgtttatagcggattgaagggagagaatattcctccaaaactaaggcccataccaaaactgatatgggaaggttttaaaaaaatcattatcatcatcatttatgtccatataatggtcatattcattagtgttggaaaaacccaattaagcgcaaataatattccaatagccataatactatttgttttagggggaggaacttatctcttgatggttggaggtctcttgaacaggtatttccaccatggaaagtttattaaggcattctatttaaaggaaatcattgcaatcattaagaagattggattttgggacatgatatccatcgtcatatgtgccatgatatctcaaacattaacaatttccacattcatcaatttagttaagggcatgttcacttcaatagagctggttttatgtataattgcattcttcttggcaccaatagccctaatgtccaccaaaagattgatctcattaaatttaagaagaatcttatcttcagatgaagatttggaaaaatttgcattctaa

SEQ ID NO: 1223 - DNA, 1024 bp, Methanobrevibacter ruminantium
atggattatttgctcattactctaaagtgtgataaaatggatttgaattatataattgtattgtttgttctaacatttcttgctaccgtagccttcacttactttgtaagacatactctacgtgatgcagatgtttcagatagccctattgtcagtgaacatagacataaagcaggaactcccaccatgggaggaatagctttcctatttgccattctattcatagtgtctatctattacagaaatacaaatattctcatagcctcatttatcatgctcacaggaggtgtaatgggtcttcttgatgatctattaggtcttaagataaaggaatatcaaaaggtcgtaaagaatgtaagcgattcagttgttcctataggattattggaccttggccctggagaagaggcaagggtaaccaccgacaaggctaaaaaacaggtatatggatatgttgatgaaggaaaattggaaattgttgctgaaattccaatcaagtatgagccaagcgaaaagaccaagatcatcgttcagctattgcctggactgtttttggcattgactggggttgtaacaacccttgggggattcactttaggcattttggcttatcctatttgcataatcgctattcttggttcaatcaattcaataaatctcattgatggaatggatggattggctgccggcatcgttgcaattgcatcattctcatgctgcatttatgcttatatctgtggaaatatggatatgattcctgcatttgcaattttaactggaatatgtcttggatttttggtcttcaacagataccctgcaagcatattcatgggagacacaggctcctttgtattaggtacaggatatgcagttgctgtcatcttaggggacattccttactttggagtattggctttggctgttccgattgtatcagtaataataagcctgatgcatagggcacatataataaatctccctgtagagcctttgcatcacaccttgaactataagggaatctctg

SEQ ID NO: 1224 - DNA, 540 bp, Methanobrevibacter ruminantium
ttgtttaacccaataatagcattatcatacatctcttccggtttctttatgaagatttcagacgatgagtatgatgagaagaacaacaagatacttgcaatcatatttggaatagtgtgcggagcatttacagctcttgcatcatcaatgagcacagatgcagcatgcatattcattgcaatactcattggaaacatattagcacagaaggtggatggaatccatcatgtcgttacaatgctttcatttttgattgtgcttgtttttcttggacttcctgcattcagtcgtccatccattcttgtcgtaatgatttgtgtggctggagccctaatcgatgagaagggaaatgacaatgagatactctatgaaaaaagcaagtttctgatgtatttctttgattacaggtttgcacttaaagtggttattttagcccttgctttatttgggcttgtggacatttggacatttgtttacttcttatgctttgagatagcatatgagatagcaagagtgctttttgagaagtttattttataa

SEQ ID NO: 1225 - DNA, 213 bp, Methanobrevibacter ruminantium; identical to SEQ ID NO: 980

SEQ ID NO: 1226 - DNA, 771 bp, Methanobrevibacter ruminantium; identical to SEQ ID NO: 991

SEQ ID NO: 1227 - DNA, 333 bp, Methanobrevibacter ruminantium
atggttagaaagaaagcaagacgtcgaaaacggcaagaggaagatcctatggctggaactacaaaccttgtggatgcaatgcttgttcttgcattgggatttctcatctttgcagttatcggctggaacttacaaagcgttatattcagtgatatggaccctcaggagcgacaggccactatggagtcaattaatcaaatcactaatgtaactcaaggagaacagttaaacagtactccagacacatcaaaccagtctggagaaggttatgtagaacaaggtaaagtttataaggattcgaaaacgggtaatctgattatggttgaaacttaa

SEQ ID NO: 1228 - DNA, 732 bp, Methanobrevibacter ruminantium
atggaactgatattcagcgtatttgcagtaataagcttggcagctatcctgcttctagggatagagctaggattattatcaaaattctttaatctttcattaaagaagcatttgattcttgtacttgcttattctatcataatatttgcagtcattgtgattctctctccatcttatgaggcagtccttaattcaacattctatagcttctattattatataataatgggctttgtatgtcttgcccttgggcttttgacccttttctattggagcaagatggagtggtatcctcctgcattgaaatgtctgctgtattttgattttgttcctatttcacttagtcttatgctgatttcaacagctctcatggctccaagctttgcatttaaggtacagaacttctctcttaatcttactatggtcaattcaggactaattctggtggttctaatggctatattgatggtgatattctatctattttccgattttgttgaggattatagagtgactcattatgctattataattggaagcttgcttcttatatttgcattggcatactttgtgctgggattcattattccaaatatggctccagtatttgcaaatccttcaacagagttgactttaatgcctattgagtcaatagttgttatggttgttcttatagcattattgcttggattgggggccttatttagaaagagaactaatagattagaatga

SEQ ID NO: 1229 - DNA, 657 bp, Methanobrevibacter ruminantium
gtgattatattggcaatgacaattcctggtggtgacttcttaaccactggacttaatttaatttcacaaagtcttttgataccggtagttatcatactattggtttttgttgtagttgtagtgatttcacttggagggcttatctatgaatacacttcaaggacaaaggtatctgtagatgacgtgtccaatctgattctggagatttccgattcagggtctgttgattccatgaagtctgcaatagcaaactctccgattcctaagcttcaaaaggacattctgcttaagatagcaagcacaggaaatatgagccctaatacaagagaggcatttgcccgtaagctcatcgagaatgaagaggggctaactgacaagtcccttgagataactgacataattacacgtatcggccctacacttggtttgatgggtactcttatcccattaggtacaggtcttgcagcacttggctctggagacgtcaatactttgtccgagtccttgattgttgcatttgatacaactgtagtgggtatcggttccggtgctttggcttatgttatttcaaagcttagaaataggtggtatgaggaatatctatctaatttagatgttttatctgatgctgtattggattttatggctaaacattag

SEQ ID NO: 1230 - DNA, 852 bp, Methanobrevibacter ruminantium
atgggattgtcactatacctattgcttgatttaatccttataacattcacattagtttttaagatagaaaataatttatattatataataatagccatagacaccatattatgtgttattttaatatatgagttttataatagattcaaaaccgctgaaaataagattcacttcagcatcagaaactctacagaaatattagctggaatccctattgacctgattttccttccatttgctcctaatcttactgtttttttaaccattttcaatcttctcaagtttctaaagataatcggactctttttggaattctttgaaacaattgacgtattccttaaaaagacccatcttgatgagattttaggattggccattcttgtaatccttgtatcaacccttggaatatacctctttgatccaagcataaacagcatattcgacagcctatggtttgtcctatccacaatcacaactgtaggatatggagacgtgcttccaaattcatatattggaaaagtaatagggattttaatattgatattcggagtgctaatcttttcagcaataacaggagcaatgacctcctactttgcaagaaaggtattcgccacaaaggactttaacattacagaaaatgacgacaatatccggcttctaaaggaagacttaagcttcaacaagaaaaatctaaacaatgcaaatgaaaaaatagataaaatcaataatgatgttgaaaagcttaaaagagaattgaatgaaatgaaagaggaattaagagaatctagacaattaaataaggaacttaaagaagagattgttattttaaatgagaatttgaaaaataaatga

SEQ ID NO: 1231 - DNA, 714 bp, Methanobrevibacter ruminantium
atgttattgcatgaacaggcattccagttgataggtgaatctatagttgttttagtggttcttataatcatcatactaattatagccttaatacttggaatcatactccttagaagaaacaaattggtatttccttcactcattatctttgttgtgaatgtattctattcccctttgaagagtttggctaatttcttaagattggatgacgctttggttgaccatattggaatagaggtgaggaataaggtaaataagccaaagtttgaccagattcctcctgaagagaagataatcgttcttccacattgtcttaggtctagagactgtgaggcaagccttaaggaaagcggaatcaaatgcacattctgtggaaagtgtgcaataggaactatcaagtcaaaggcagagcctatgggatataaggtgtttattgtacctggatccagctttgtaaagaagataatagagcaaaacaagttcaagtcagttgtaggggttgcctgccatgtagatttgaaccagaccatgatggcactttcagacttctatcctcagggagttcttttatccacttctggctgttttgagacaagagtggatgtctctaaggtcttaagcacaattgggtattatgagtataaggaaaaaaataaatccattgatgatgaaaaggacgactctgaagacataggtaggataaaacctagttaa

SEQ ID NO: 1232 - DNA, 852 bp, Methanobrevibacter ruminantium
atgaattttaacttaaaagacatgattttaatttttatcagaggtttccttatgggctctgcagatacaattcctggagtctctggaggaaccatcgcattaatcacaggtatatatgaacgtctaatccatgcaataagcagcataaaattcggatttataaagccattaatcaaattggactttgccggatttaaggaaaagctctttgaagagattgattttgaactattcatacctcttgttttaggtataggtattgcagttttaaccttatccaaggtaataagatatcttcttcaaaattatacagcatatacattttcattctttttaggccttattttggcttctgcctatattttatacaccaaattggatgaaatcaatataaagcttatcatattaacaataatcggtataatcttatcatatatatttgtagggttaaacccaattgcagctaaccatagcctaattgtattattcttctctggtatgattgccatttgcgctatgatattgcctggaatttccggatcattcttattattgcttttaggacaatatgcatatatgctagattcattaaattcattaaatttcactgaaatcattgtctttattgctggagcattcataggaatcttaggattttccaaaatccttaattaccttcttgaaaactatgaatctgctacaatggccttcctgattggaataatgattggtaccttgaggctacctttcaatcagatcacaagcaatttaactggatcttggttaatctgcttgattttagctataattggagttgtcttaatagtggtcttagagaaaaagcttagttaa

SEQ ID NO: 1233 - DNA, 969 bp, Methanobrevibacter ruminantium
atgaaagggacatggaaacttaaattacgattatggctttctatggctgtcatgttcggtctggtttatgtactgatcatgcttgcaggaaatttcctaggatacagaggattctacggattctacgcaattgcaggactatttgtcctattcctccaatacatattcggtccaaagattgttgaaagctctatgggggttcattacttatccgaaagcgaagcccctgaactgcaccaaatggtagcggaattagctcaagcggcaaacattccaaaacctaaggtaggcatttcaaataccatggtgccaaatgcatttgcatatggaagatccaaacgcagcggacatgtatgtgtaaccaaaggaatattaggccttcttgaccatgatgagcttaaggcggtcttaggccatgagatatcccatatcaaacataatgatatggccattacaactgttgttagtgccataccattaatctgctattatttaggattctctttaatcttctccggaggtggaggagacaacaacaatggcggaggagcattaatcggctttttagctttgattgcatacttcctaggccaattgattgtactctttatctcaagagtaagggaatattatgcagatgctggaagcgtagagcttggatgccaacctgaaaaattagcttcagctctttataagcttgtttatggtgctgcaaggattccagagcaagaaatcaaggatgttgaaggaaccaaagcatttttcttaactgatatcagcaatgcaagaaatgaaatcaatgacttatcccagcttgacttcaatcgcgatggagttattagcaaagaagaattggatcagttaaaaaacaataatgtaaagatttcaggttccaataagattatggaaatgctctctacacatccagacatgcttaaaagaataaaaagattagctgatatgaattaa

SEQ ID NO: 1234 - DNA, 633 bp, Methanobrevibacter ruminantium
gtgaaaaagatgatatgtccaaaatgtaatacagtaaacgatgataatgaaaaattttgtaaaaattgtggtttgcagctgaatacaactagaatatgtcctaattgtaacactgcaaataagccaaattccaaattttgtcataagtgtggtactaccttaagccctgtagatacatttaaaaaaggaattatagaagaaaatacaagcaattctttctttagtacatacaagatacctataatctgcgctttagttattttactggctatcggcgctgttacaggagtggctattttcggtggtgacggcaataatgggatcaattcaataatccctttggcaaatgacacatatgacgatacaaacttaaataattatggcgtaaatcatgacaatgtaagccaaactcaaagtgataactttacagaaaaccagactgacaacctaacagacaatcagactgtcaatcagactgttgaaaataaaacaaaaactgcaactgttcaaaatcagacagacaataataaaacaagcaataacgatacaaataaaacaaaagtctattctgaaaagactaacactacaaacagttcagcaaaagtcaacactgaaaagacaaaatgcaactaa

SEQ ID NO: 1235 - DNA, 1024 bp, Methanobrevibacter ruminantium
  modified_base (833)..(833): a, c, t, g, unknown or other
atgaagcatagattaaatttagataagaaagacccaaattatattttgttgaaagaaatatttaaaattatggattcaagagaatccaaacaaatattggtatcctatggatttaaaaacctaaacagaacaatatttgcttttaaaatcatttttataagcatgttctttgaaattgacattccattcatcctaaatgaactcaaatccaatagaagactctgcaaattccttaatatttctgaagttctgactgcagatcaagtttataaaatcttttcagaaataaactctgaaaaacttataaaatcattaaacagaatcttaaactcaagaaatatggtcaaaaggagaggaaaaaagactttcattgtcgatgcgactccagtggacttggatatcaatttccgcagaaataaaaagagcaaagaacatctcaaaaaattgaatctcaaatggagttattcttcctctaaaggttattatattggatttaaagcgactgttgtgatggattacgattctatgaatcctgtttgcattttaatccattctggagctccaaatgatgcaggactttttgaagagattttagaaaaccttcaaaaaagacgaataatcagaaaaggagatacattaatctttgataaaggatattacggctataaaaactaccaaataggaatcagcaaatacaaaatcattcctttcatttttccaaaagaaaaattcagcagaacccgacttgatgacattttaacctatccactagccgtatttaacaaaacaaagagaataatggaagaaaaaagattatacaacaatttaaaaanggaattaatagaaaaaatagattcatgggagaaatttaaaccaataaggggcaaaatagaagattttttcaaattattaaaacaaggcttgaatatgagagaaatccacaaatatactctaaaatcagtagaaaaaaccgtttatctaaatgtatttttgggagcactgattatatcacaaggattttact

SEQ ID NO: 1236 - DNA, 639 bp, Methanobrevibacter ruminantium
atgataggtgacgatgacttctttatgcagaatgcagactatcactatggagctagcgactcagagaagatgtatggaagaggctatgatggctcttcagactatgttccaagatactcatcaggaggcagctatggatcttcctctggtgcagaaagctcagaagacggtagccttggaaaatactgccttataggaattctaattgttcttgggatagttgtttttgcaaacattggcattccagcaattactaattcattgtccagttcagtgacagtggatgatttgaatattacccgatacatctattcaaaccagtataactcaaaaatcactaccgattatggatatcagattacatacaaagagagaagctatggccagcatgccacaaatgttattttctattcgaaaaatgggaaagtattgtataatgacagccaatatatgggaacttgctatcttggggaagtgccatacataatctattttgatggaaaggcagactatgcaatatttgaagtatataaaacccaatttgattctggtgagtgcatataccgtgaaagagtggatgttgataataaaaatgtgataaaagagtttattaattatgatacattgtatgatgattaa

SEQ ID NO: 1237 - DNA, 231 bp, Methanobrevibacter ruminantium
atggcagaactcatggacaaaatatttgtagtgataggatacattcttgcaatactattcccaatagtcggaataattgtcggagcattattatacttcttgaaaaaggaagatgcattctaccaaacacatggaaaatacataatcattgttggtattgctatgattgcaataaatatccttttaattgcatttggcataattaccataccacccgtgggacaggtttaa

SEQ ID NO: 1238 - DNA, 786 bp, Methanobrevibacter ruminantium
atggataatagaaatatactaatcattattggaataatagtcctaatcgctgcagcagggattattctagtgatgttaacatcagaaaattatgaaagaatggagatagtgccaaacgggacaagcatagatgttccattaaacaagaccacatatgatggagaattccagagcgctagagtttggcattgggacaagggaatattagtcacatacaatagccatgaggataaaaacattttaagagtaagtgaattgggcatttacactctaaataaaataatagaaactggagaaaaggaaaatatcgatggatttacctcttatgtaataaatgccgatgagatattggaaatcgagctattcgatgccattaaattacattataccggcaaattctattgcattccattagctaatggaactaccggcgacgttatcataatctgttccaacgacagggacgaggcagttcatatggccaaatcaatccagtacaagaatgtttttccagtaaatagcgatttcaataacacaattgaaactgtggagaacctgagcgaatatctggagtcaacagtaaatgactatgcaaacagcactgattttgacaatgccgtttcaactgtggaaaacctaactggaaatctagagtcatcagcaaaggattatgtaaatgatgccaatttaagtgatgtcaaaacaacagtggaagagaaaactggaattaatattgatgatgctaaatccgatttggagcaatacattggaaagttgacttcataa

SEQ ID NO: 1239 - DNA, 756 bp, Methanobrevibacter ruminantium
atgccattggatataattgaggatatatggaagtatacaacaaataataaaacatttcttttaattattttggttttattctacttgttttgtatgttcatgcaaatttttgatgaaatgaggatatcctatgcactttatctgtcaatgataccttatattttcattgcaggctatggaatggctataactaaagatgtaattgataatggtaagcgattgcctaaaatattaatcaaagatgtcattgttttgggaataaaatcaactgttgtttttattgtatatctttctgttcaagggatatttttttccctagtatcttatctatgcaattttccaataattgatgttgaagacctattgttagatttttttgaaacagcacctttattatttcatcataatcttgtaaatacgcttatttttattgttgttgattttgcagtattttatttcaccatgttcttcatggaaatgggattagctaaattagcagacactggcagatttttggatgcttttaatttgattaagattaaaaagattattgatataatcggatggagactatatgcgaaacattatacagtaattatatttttattgtgggttttctcattgcttatagacgtagagactccattttttgttcttgattatatttttaaagtatttttaggtttattattgttcattactcaatattggggcataggtgcagtttatagaatatataaaattaaaacaaactaa

SEQ ID NO: 1240 - DNA, 498 bp, Methanobrevibacter ruminantium
atggatattagaaaagtaattggaataatattaatcattttgggtttaatctttgcaatctacccagtttacagcgcccaagcagtctcatggattgcaggagtagctctaatagcatttggtattggcttaatcctcgacggattctccatatggagcatgatggctggagtttcagcagcaaaaatattgctgggaatcatagcagccataatcggattcatgttcctatataaagtggatgcattatccttcattattgcatatcaattctatataattggatttatactgatatttgtcggtttgctaggtatttttatagcaatagatggaatatcaagagccacagcaatattgactttaatcttaggtataatatgcattatctgtgctttcttctcactttcacagccattatacactgcagttatcgttggaatctgtatgataatggagggaataaccttcctagcaagtggcataattgatgaatga

SEQ ID NO: 1241 - DNA, 1024 bp, Methanobrevibacter ruminantium
atggataaagaaacaaaagaacgtctaggagaaatcagagctgcgatgaagaaatacggctttgataagattttaggcgaaagcgcaaaaaacaggatacgcggaaaagatgaggaagaagagagcctcctattggatagcgaagttccagtcaagttcagacttatgcttcaggaacttggaacaaccttcatcaaactaggccagctcttaagcacaaggcctgacatggtaggggaagacattgcaaacgagcttgccaaccttcaggacgacaaccctgcaataagctatgagcaggttaaggcaatagttgaaagggagcttgaaggagacattgacgaactctttgccgaattctcacatgagcatcttgcaaccgcatctatcggacaggttcacgaagctaccttaaatacaggggagcatgttgcagtcaagatccagaaagagggaatcacagacaagattgacctggacataaggataatgaaatacattgcaaaccgtgcagacagattaagcggcgagcttaagaaggtaaatctccctggagtgatggaagagttcgaccgcagcatccacaaggaaatcgactactacaacgaattcatgaacatgcaaaggattgagatgaactttgtagacaatccaaatgtccacattccagcaacctatcctaaatactgtacaacaaaggtccttacaatggaattcattgcaggagcaaaactgaatgacgtatatgcaagcgaaggagacgaatttgacaagaaactccttgcaaaaacagtgattgactcctatctccaacagcttctcatagacggattcttccatggagacccacaccctggaaacatcatgattctggaagacaatgtattgtgctaccttgaccttggtatgatgggaacctttgacgaggacttcaaacgcaacctcgcagaggcaatcttactcattatggaccaggacattgacggagtaatcaaccaattgatgtacatggacatcttagact

SEQ ID NO: 1242 - DNA, 693 bp, Methanobrevibacter ruminantium
atgacagaaatagattggtttaaatttgaagatagggattacgattttccattttataaaaagaatccccatatttcaaaaatgggctggcttgtcttattctttgtttttataattggatccatcttatcaatgagcgataagctttcatattcaatattatgttgcatagtctttatcgttccagtattatatttcctagactgggactataaggcaatatttagaaagccatctctcaaggacattgcccttgcagtggcactttttatcggatatcttatatatgcaataattatgggagcaatattggaatctgttggaatagtgagcagcggaatcattgatcctggaagcatagactggacagtacttattaagagcgtcttttcattaatgggggaagaattcatcaagttccttccattcatattcttcctaagggtgctttacaagtacacagataaccgtaaattgtctgtggtgatttcagtcgcattggttatggccatgtttgcatctttgcatgcatacaattgggtcatgttcatatatgcattgttcatacaaggctttggatcaatttttgagttttttgcatacatcaagacaaaaaatataattgtttcctatataacccattattgtacagatgcatttatctttgcaatgctactgcttggacttggataa

SEQ ID NO: 1243 - DNA, 723 bp, Methanobrevibacter ruminantium
atgatatgtccaagttgtggaagtgaaaataaggaaggttctaaattctgtaaaaactgtggtgaaaggttaactgatagttctagacctaccagcaccaatgctagtgcttcatctcaatcaaagagcaataagaatcttttgattatttgtgcaactataattatctgtgttgctgttgttgcaggggctatcctttttatgagtggccagtccactgattatgaggtggcaagcggtgaggctactaatgatcattcatcatctgccttgaattcctatgacagttccaattcaaatgatgaaagtcaggatgattcagcatcagcaagtgaagattcaagcgattcggccgatgaatataataagaatcataaatggggaaagagtttccaagaagcatcagaatatttccctgaagcatctgaaacagttgttactcatgttttctatgaagcagacattgacggaaatggctttttgactgacaacgagtttaaagactttaagagcttggtcagcttcactagaaagtatgcagcagatgtaactaataatgattatgttgacactcccgacctttgggagggagatggaagcgttagaacaagatactgtgcagatcatggtagaatagcagttggcagtgatgacaggtgtccgtactgtgctaaaaaaggtcaggacagtagaaccagaagcggttcaaccagatatgtttaa

SEQ ID NO: 1244 - DNA, 159 bp, Methanobrevibacter ruminantium
gtgtctaaaaaagaagataattgtcaaatagatgattgctctagtggaacttgtgcacctgtcagtcccttttcaaaagagggaatattatttttaattttcatcattgttttattcatagttctgtttttcttattatggactaatggattgatttaa

SEQ ID NO: 1245 - DNA, 1024 bp, Methanobrevibacter ruminantium
atgacaaaacttataaaaagagaagttaaaagggaatataacgaggaaagtcctctaaagcttaagatagctaatgccatctctacttttacaaatcctccgattatttgtattcctttgtttttattgatttcatttgtgcttgcatctaacggaaatccgttttcaagtagtttcagctttgactggatgctatttgccaaatgcgagatcatttcacttgtatttgcatctgtccttcctatggcaatcataatctactgggcaaagaagctgaatacagataaggacatctcaaatcgtgaagatcgcttcattccccttatcgtaggggtgttgtcctacctgattggctttgtaatatcatttttcttcgaattgccaaacttcctgacaattcttctcttatgttatgcagtaaacacattcattgtcatgctcattacaagcctatggaaaataagcatacatacaacaggattaagcggacctgtagctgccctaatcatgcttcttggacctattggtgcattatttggacttttatatcctgtcctaatctggagcagggtcacccttaaaaagcatacaatggctcaggcaatagcgggaggaatattcggattcgtattcactgttggtgaaagctatctttatatgcgcctgtttaaaatgagcgttccaggccttgtgccgttagcggaatgcttctggatcatatttgcccttgttgcctgccctatagttcttggaatatgcgggcttttggaaaaaagaggaatcgaatcagttataagggcaaagctattccacctattggctttcatcggatttgcagcattctacttctacggaccctctagcgcagtcttgattcttatattaagcgctatagtaagcgttttagtaacaatatttgcaggagatacattctcatggtataagggaatcagcagaggacttgaaagggaaaacctatcaatagtgctctcacttgcttgcggtctgatttggatatatgtgg

SEQ ID NO: 1246 - DNA, 141 bp, Methanobrevibacter ruminantium
atgaaagaaagagtatgctctccagactgtgagaaagtattagaaatgaatcagaaaaacattagaaaaagcagaatcatgttatttgctgtgattgttgtctttattctcgtatgggcatatttcatgttctttaaataa

SEQ ID NO: 1247 - DNA, 915 bp, Methanobrevibacter ruminantium
atgccatctgaaaaagtgaaagaatttaatgaaagccttaaaacaaaggaaggaagagacaaattcttcaagcaaatattttgtatagctattggaacagtggtaggtgtagccacatatgccttctgcttatactttaatcttgcaatattcggatggaatattggattggcattatcccctctcactgcaggatacgctgaaagcattcttgctaaaaagatccttaatgagagcacaggtgcaataagcgcattcattcttttcataattactgtagtctacggattcttcatatccaactctaccttaggattcaatataattacagcaggaagcgcagtggtaattattcaagcagctatgcctacagctacaaactatctcctgcttgcagtaggagtgggaatcctaacttatgtaacaggtttcttaaagaagttacattctgccttatataagggatataagaaaatatttaagagagagccaaaaagagctgaaagatactatcagaagcaagcaagccaagtgcatgcattctatgatgaaaatctggatataaatagtttaggagttcttataatgacactggagtatcctcctaaagaattaaatatcatagagcaaaagggaatatatgaaaccagacatattttcggttccaaacagaaggaagatataaaatccggacttgaagactccttggaagaagaagtcataaatagagtaaagcttgcaagagataagacattagttaaattgattaaagaggttaaagccgacggatgcaatggtctgatgcatttgcataccacttatgaaaccctagggacagaaaagggagaccacattgcacaagtggttatgagaggaactggtattgttattgaaaaagaggaagaggaatattaa

SEQ ID NO: 1248 - DNA, 738 bp, Methanobrevibacter ruminantium
atggttccattgcagtttttcctattcacttcagttggagttgacccttcccttgccatgatggtctctcttggaaccagccttgccatcattattccaacggcgtcctctggagcctatcagcatcagaagaagaacaagtccattgtcagaccaggaataagattagctgtttttggaattattgggggattctgcggaggtcttttagcaaatatggttcctacaagaatcctgcagatgatatttgcctgtctattgatttttgtagctttggatatgctatttggctccaggtccgatggggaaaaggcattaatcgatttcaatttgttaaatggaggtatcgttggattttccataggaatcatctctggattgcttggcgttggcggaggagtctttttgattccatcactttgcatactgtttggattcagcttgattgaagctattggaacatcctctgtattcattgcatttacagccattggggggcttatatcttatatttacacaggttttggagtaaatccaatgccttattgcttaggatatgttagcttgataaactttgtagtgattgtattgttttcagttccgatggcgactataggagctaaattagtttataaattgcctgagaaaagattaaaacaaatctttgcaataattttgatttatatggcaattaaaatgcttggattcgatccaattagcatcttgttaggtctataa

SEQ ID NO: 1249 - DNA, 1024 bp, Methanobrevibacter ruminantium
atgaatttaaaaataaacaaatatattccatttggaataatattaatcatacttggagggtctttatacttcttaagtggcatagaccaattcataagaccatttacccaacctattctaatgggctcctcaaagggtaaggacatactattctttgttctatttggaataacaatcatcttgtcctccattggagataatgagaggattcataactatcttatgaatctatcaattccagaaaagcttaaggacaaggacttttatttaaagctctccttgatcttgtttttaataacagcaatatcaggattagctgtagaattgtacttaagagcatctcttgggcttaactggaatacaatacttgtaatcatgaatcctagccttacaagcacaagctttctccattcccatttatataaatcaatatttggaattatccttggaatcttcttaagccatattccagcaggaatccatacaggaagctcattaagtagctatgccccaagtgtgataagcctgctctttatattgattccaataacttatatttctatggttctatctaatcaaaggcgaaaggcagcttctagaatacttttagcctttacaagcactcttggaataatcggattgattgacggaggcctctttgcaactcctgcaatcggaggaatctatggaatccttatattgatgtacaatgaagagattttagatggaatttcagactttataactgaaaaagacaaaagagatggaataaaagagaaattaaatgaggaattaagggcgattaagtcaatctttaacaataaaaatataaagaaatatttgaagattgccttgcctcatattgcattgattctaataatcatcttaaggttctctgttgcattctatggtgcatgtccagattcttatgaattgattatatctaatggccacgatcttgatttagatgaatatgatacattaaatatatcagaaaatggagataggactgttgttcatcttt

SEQ ID NO: 1250 - DNA, 342 bp, Methanobrevibacter ruminantium
atggttaagattagtcgtaaaaatagttttgatgaaagcagtgaagaagaccctatgtcaggtgttgccaatcttgtggatgccatgttggttattgcagttggattgctggtgtttttagtcattagctggaatatgcaatctatcatattcaatgaggatctatctccccagcaaaagcaagaggctattgatgccatgaatcaggttattgaagtggatcaggggcaacaattaaatgagactccagatataagcaattcttcaggtgaaggctataccgaaatgggtaaggtttatcaggaccctaagacgggtaagctgataatgattgaaaattag

SEQ ID NO: 1251 - DNA, 630 bp, Methanobrevibacter ruminantium
gtgggtggaggaattctaacttatatcttagacactcttagtcaaagtttacagattccagtaatcatattcttacttatattcgctgttggagcaatcatccttttaggaggcctaatcagagaatatagtcatagaaagaccatctcagatgctgaaatgagaaatattattgatgcaatcaacaaggctaatgacaaatctgagattttatccattgtagactcttcagatattccaaactctcaaaagactgttttaagagagattacagattctgactgggacaatgaatcaagagtgggccttgctaaaaagcttataagttcaagagaaaagagactcgaaaagcgcttgtcatacactgacataatcactcgtatcggtcctacattagggcttatgggaacactcattccaatgggtccaggacttgctgcacttggtacaggagacgttgtaactttgtcaaatgcaattattgtagcatttgatacaactgtggtaggtatcggttcaggtgctcttgcatatgtcataagcaagataaggcgaagatggtatagcgaatacattaacaatattgatgttttaactgatgtggtattgaataagcttaataaattataa

SEQ ID NO: 1252 - DNA, 1024 bp, Methanobrevibacter ruminantium
ttgggagaaaatgatagatcttgtcttaattcttgttcttctttaaaatattctttaggtgataataaaaataatgacttagataatagtgctgatttgaatagtttaaatcccaatagcaataattgcttaaattccaataaaaataattgtaattgctattgcaagaatcaaacagatcttaatgatgatttaaacgattcagataactgtcctgacagttttgctaaaaagacaaatattaatcatgataagcagttgaatgatggtgagatagatttctccgagcgcaataatcaaatcttcctgataagtcctgaaaacttcagtgttttctttgatgaaaataaccgcttaaaggaagattatgggggatgcacccttgtatttgaaggggatttcgctgagcttggcataatcgacatatcatatccttacactcgaatcactgcaaaggaaaactcattcaagaatactgcattcaagctttctgcatctgatatcgaactttccaatctaaacataagtttggataaggaatttaaagataacgaatatgcagggattttggttctatctgattacattagcatctacaatattaccctaaactatacggttccagccaatacaaacggattttgcatctacagcaaaggtgaaggctttagaagaatcactgatttgtccttaatcaacaacacaatcacctttacaggcaataatctaaatgaggcttgggattatggcattttccttgataagacagataatgccttggtttatggcaattcacttggttcatatttgccattatgtgaagacaattggtataataatgaatatggtgctgtcagcaagatgtccagcgctggctttgtagctcaaagctgtaatgatctaaagctgtccagtaatgaaatcaatacctatgttacagattccacccaaagctcatttgctatggattcatgcatattatatgattgcagtgaccttactgtcgaaagaaacactctttatc

SEQ ID NO: 1253 - DNA, 1024 bp, Methanobrevibacter ruminantium
atggctgatgaaattgctacaataataagttccttaggactttccaatgaggcatttttagcaatagttcttttagcgtttgtagttattggtgcaattattgtaattgtcgcaactagaccaattttagatgtttacccatatcttcatcctaatgcaagagtaagagcaagaaaaggaagattgtttgatgagaaacagatttcagaacttgttgaagcaaacaacgttgatgaaatcacaaactatctcagaggatctcctgactatgcagactacttggataattatacacttgaaaaggcattggacattcagcttggtgaaacctatgacatggtttccagaatggctcctaaagagattcaatcttcatttaaagtaatggctaaaaagtcagacatcaataacattaaaagtttattgactgctaagcaagcaggattaaacgaagaagcaactgctgaccttttaattcctactggttctttatatgaagatatagaacgtttgaccgacgctgatggtgtaactggcgttgttgcaggattagatggaactgaatacgctccagtattggaagaagcacttccagaatatgaaaagactggaatggtccttcctttggaatcagcattagataagtattacttatccaaattgctcgcttcctctgaaaccccatctgatgagaataagcagatactctattcttatgtcggtaatcaagtggatgttgcaaatatcaaattaatattaagagcaaaggctgatggattagactatgaagctatcagcccatacatgattgatagtggatatcaattaagagaatggaagcttaaggatcttatggaagctgaagacgtcactggtgtcatttccggtttggaaggaaccaaatactcagacgtccttgttgaagtgcttcctgaatacaatgaaactggatctgtagctctctttgaaaaggctttagacaagttcttagtcgactctgcaaaatcctattccatgaaaaagc

SEQ ID NO: 1254 - DNA, 486 bp, Methanobrevibacter ruminantium
atggtagaaattgctttaggtactgctttagcagcaattggtgctggtgtagcaattggttttgctggtttaggttccggtttaggacaaggtatggcagcagctggatctgttggagctgtagcagaagataacgatatgtttgctagaggtattattttctcagcattaccagaaactcaggctatttacggattcttgattgctattttattacttgtattctcaggattattaggtggaggagaaggtctctccacaactgcaggtattgtagctataggtgtaggtgcatctattggatttgcaggtttaggttccggtatgggacaaggtatggcagcagcttcctctgttggtgctatcgtcgaagataacgacatgttcgcaagaggtattatcttctctgcattaccagaaactcaagctatttacggtttcttgattgctatcttacttatggtattcggtggaatcttaggttag

SEQ ID NO: 1255 - DNA, 1024 bp, Methanobrevibacter ruminantium
atgcgtaagcttaatgttataactttggacaaatacgctggtcctacggtcagtgcacttcacgacgagggtattgtccaaataaatgatatttctgaacgtattcagcaagatcctaagctagcagaacttttgaaaccttcaaaagttacaccttatactggtaagctgtcctcacttcttatgaagacaagcgcactttccgatcttctcggagatgccctttcagaaggtcagtcccttaaggacacccttatgtctttcataagccccgatcttccagttcctaaagaagtcgaggatgttgatacagaaagctttatagcttatgctgaatcaacattaagccaggttgaggctgaaacaaaaggtattgaagataagttagccgcactagacagtgaagaaagtaagcttgaatcaaataaaagtttagcttctaagcttaaaaatctggatatggatttagctcttttaagcgattcaaagtatacttctaccattgttggtaggatcactgctgagtcagctcagaaattcaaaagtgaatacagtaagattacagaggatctcttttacgaattggttccagatgatgagaaggagtacaatattcttgttgttgtcgtagccaacgagtttaaggatgacatctataccttacttaggaaaaatgaattcgagaagtttgaaactgaggatttacaaggaagacctgacagtcttatttcctcttgcgaatccaggcttcaggctatcgaaagtgaaagatcccaagctaaagctgatttgaaagttgtagcagaaaaatgggatgatgaagttcttgctttaaaagaacaattggaaaacgaaaaagagaaaaatgaggttttcgcaacatttgctgaaaccgacaagactgttgtccttgaagcatgggtgccagagaaaaacctggagcaagctcaaagcataattgagactgctacagatggccacgtgatcatggaaacagaagaggttccagacaatgctgaagacg

SEQ ID NO: 1256 - DNA, 339 bp, Methanobrevibacter ruminantium
atgagaaaaattatattattggctttttcagctcttttaatcattttagggctttggaattatatgagtgtacctaaaccaggtttagacattattgcatcatcccttgtgcttgttgcagttggttggactcttgcaatgtctgtttttgaacctaactggattaaagcagctatcttcattgacggattggtatttgtacttgtatctatcacattcttagtaagtcctatcaattatgtgttccttctctttggaattattttggttgctatagctgttttagcttatcttagaaaattaccagacaatatattaagatacttctacagatcttaa

SEQ ID NO: 1257 - DNA, 372 bp, Methanobrevibacter ruminantium
atgaaaccaaagatagttcgtgcaagggacaaagaggtaatgaatcaattggcaaagctttttgaagagtctaaatacactgtcaagtcccaggataagaattatgtccttcttaagaagaataattatggaaatcctttaattcatcttccattcatattgattggactgttcttcaatgcatttgctattctagttaatgtggcctattttgcctacagtgtttttaaaaagtccaatgtaatcttaattacaactgaaaagaatgatgaagatggcaatcccttggaattcgatgacgtcggtgaaattgaagtattctacgaccaagaaacttgggataaggcgatagaattatctagattggaataa

SEQ ID NO: 1258 - DNA, 1024 bp, Methanobrevibacter ruminantium
atggctatcggtgtaaaggagattaagattaccgacaccatcagtatcctattattacctttgatttatgccttggttttaggtttagccctttatttggcaaagcctattaagtttataggcagaaagcaatctaaggtagctgaaggggctatggttctatttattggtgtattaattaccaaattggctatttcaagcggtcaagccatagccagtattttccaagtggggcctgctcttctcttgcagcagataggtaatttaggtactcttatagcattgcctatagcactctttttcggctttagaagggaagtcatcggtatgacaagttccatttgccgtgaacctaacttaggagtcattatcgacaaatacggttttaaatctccagagacccgcggagtattggctgtttttgttatcggatccattttaggtactccattcatcagcttcctatcaagcataagcgcttcactgattcctatgcacccatatgcctatgcaatggcttcaggtgtgggaagcgcaagtatgaatgccgctgcccttgctcctttgatgcatatgtttccatcaatggctactgatttggaggcttttgccggatgcagtaaccttctttcattctgtttcggtatctatatgtgtatatttgtatcattgcctcttgcagagcgtatgtataagtggctatcccctcatataggccatgacaaagaggaaacaattgacgatgagtatgcaatcgaaggggtaaagcatgataagtatgcatctaaggaagagttaagttcaggaaagattaaaagatgggctacattccttcttatattctcattcaccgttgctgtaggaaattatataggatatcacacttcattgctggattcattcattggaatgatcattatttcacttataaccattctgggaatgtctcttgaaaggataattccttggaatattcaatcaatcatttatataagcctgattggtataattgtggctattccag

SEQ ID NO: 1259 - DNA, 111 bp, Methanobrevibacter ruminantium
atggagataacaaccaaaaggaagacaacaatgtggaggttatactccttccatggaggtctctttttaattgctctatccgttttttccctaaatggatgtgaagattga

SEQ ID NO: 1260 - DNA, 219 bp, Methanobrevibacter ruminantium
atgaaaaatcatgcaatttcacgtaaagaatttaaagaaaggagaattgatatggaacttaattcaaaacattacacaattattttaatcatagcaataataattgcagttattatgacctatatgactggaataaaaaacccaatcattattggactttgcatacttgccataattgtaattctagctaatttataccttactaagcttaaaaaatag

SEQ ID NO: 1261 - DNA, 930 bp, Methanobrevibacter ruminantium
atgtttgttgaagatttaataaataatttatcaaattttatagaaagcagattaagcgataaaatattaattttcttacaggaatatttcttaaaggcaggaatattcactttggcctctcaaatcattgctatattgttcatttcaattgtttttacattgatattggctttgatgattgcattgttattttcatttgatattcttatggcaattctattggctattttcattcctcttttgtcttttattctatttgtttttataaaatccgagcgaagaagggaagagcttgaaaactcaattccggactttttaagacaattggcttcaatgctgcgggttggaatgagtcttgagaatgctcttgttgatttgtcagagcatggaaacggcccattatatgatgagctgcgccgtgtggttgttgagataaggatgggaaagtcttttgatgaatcctttaggaatatggcgaaaaggcttgactcaaaggatcttgaacgtagttttaagattatcttaaatgctcataagagtgggggaggtcttgctgatgttattagtgatgtcagtgatgatttaagggctatgctgattttaaaaagggaaagaaagtcgtctgtaatgatgtcaatcatgtttttggttttggcatctgttgtagctgctccctttgctttgggaatggttggagtctattcttcctttatgattgaattgaacagatcaagtgccatctgtcaacttgccccaacggttgctctgatctatctgatcattcattcgattttggcaggatttctcatagctcttattatgtatggggatattaagaaaggtgtaaagttttctattccaataaccgcattagcatttttcttattttatcttattaatgtgtttggactatcctttttcggattctga

SEQ ID NO: 1262 - DNA, 438 bp, Methanobrevibacter ruminantium
atgaaaatggagattattaaaaggattgggattggagcatttgtaggatgttttgtagtgatgcttgtcatggtgcttggaacatatagccttggtccgcagaacgtcagcttttccggaactgaaatcattaatgcattcttcggatcaatagttgtaggatgggcatttgccttcagcggactcatttatgaaaaagaggacattccattacctattcaagtcattttccaaatggtaatcggattgggaaccctatttgctgtagcagtctatttaggctggatgcctattagcttaggcatagggcctataattacttggatagttattgcaattgcctttgctgcagtcttctggctaggattttacttatattacacattcctagcaagggacattaataaaaagatagaattatctaatgattttgattaa

SEQ ID NO: 1263 - DNA, 447 bp, Methanobrevibacter ruminantium; identical to SEQ ID NO: 876

SEQ ID NO: 1264 - DNA, 1024 bp, Methanobrevibacter ruminantium
atgaaagggaatattcttaagaatattgatgaaataattaaatcggattttaaatcagcattttcaaatccaattgtagttattgttctaataggcataattatccttccttccctttatgcggttttaaacatttatgcatgttgggatccttacggaaatactgatgaggtagtatttgccattgccaatttggataacggctccacttttaagggagactatattaacataggaaatgaacttgtcactgaatttaaaaataataacgatttcaaatggacatttgtttccgaagagaatctgcggacgggagtttttaatggaacatattatgcagggatagtcattcctaaaaacttgtcggaaaatgtggtttcaattgcgactgacaatcctaagcaggcaaaattggaatatgttgtgaatgtcaagacaaatcctgtagcttctaaactaacagattctgctgcaaacagaatttacatggcattgaatgcaaagatagttaaaataatcgatttggcagcttatgaaaagttgggggaattgcagaaaggtcttgcatcaggttcccagcaactctctagcggaggctatcagcttcaatcagggtctgcccaaatatcttcaggttcccaccaagtctcatctggagctaagcaagttaaggacggtaaacagcaggttagcactggagctgaaacagttaaaagcaaggcttctgatttggatgaaggtgcacaaactgttcaagagggctcaaattatataaaccagaaatctgaagaacttcagcagggttccgatgaagtgcaggctgccgcagacccatcgctaatgcctgatggccctgtaaaagactatgtagatgccagtgttgaacttgcaaatggaagtggcgaactggctaaaggttcttcacagttagcaaacggttctgttcaattggctaacggttctgttcaattggcaaatggttctgttcaattggctgacggttctgttcaattggcggatggtt

SEQ ID NO: 1265 - DNA, 357 bp, Methanobrevibacter ruminantium
atgttagacataccaaaagaagaccctcaagttagaagattcattaaactagttaaagaagagggatacagttatgaaaaagctttagaagaagttggagcagactatatcgatgagcgagattgggaatatttcggattcaatcaaagagaaggagattatagggacttttataatttaagacatcctcctaaagaacatcattacttatcagggtccaattcatcatcagggtccagttcaaataaaagacagtccagcaaatgggatgatttaaaatgttatatgagtgttttaggcccattgataataatctttgcaatagcaattctttggggagtttttaaaggagggtaa

SEQ ID NO: 1266 - DNA, 909 bp, Methanobrevibacter ruminantium
ttgaccctgcctggagcatccattggtcttgctgagttgtttgatcctgattggtcccttttatacaattatagcatatggatggctgcattcggtcagatattcttctcattgagcttgggaatgggggctggatttacatttgcaagctataccaaaagggacatagacttgatttcaagtggattatgtgttgttttggctaatagtctttttgaaaactttgcagcattaggggttttctcaattctaggatatatgtcccttgagtctggagttgctgtttcaaagcttgtatcacaaggcacaacactgatttttgttgcatatcctaaagtgtttaatattttaggaggtgtcgctttgattttagggccactattcttttttacagtttatgttgcaggagtcacaagcatattgtcctcctttgaagtgctttcaatttccattcaggacaagttcgctttttcaaggaaaaaggctacaaccgctttatgcattgttggagggctggcttcaatggtctttgccacttcagctggaggttatttgcttagcattgcagacatatttgtaaataatattatggttttgttttcagtgattgttcaaaccatcctttttgcatgggtattcaaggctgaaaggctggtggactttttcaatgctaaaagccgatttttaaaacttggaagatggtggttaatccttgttaaatatatttgcccaatccttttaactgtaatctggattggagaattatataatcttataaaaatgggttcaactgaatttgtagtgattttaggagtattgcttgcaatattattgatatttgcatttatatttacaatcaggccagcaaaaactgatgaatggtttaaaaccgaagagaggattaagtaa

SEQ ID NO: 1267 - DNA, 567 bp, Methanobrevibacter ruminantium
atggctaatgaaaatgaatggggcagcaatcttgcatttgtacttgcaatgattggttctgcagttggattgggaaatatctggagatatccatatgtgctttattcaaatggaggcggagccttttacattccttatctaattgcaattttagttttagccattcctctcatcattctagaatatggggtcgtctataactataagtcctcatttacaaaggctatcgtaaaaataaagcctaaattggaattttatggttggattcttcctgttgtcacttttattatgacaatttactattcaaccatattgggctgggatggaatctatttcatcctaagcttctttaagggctggggatcagatccaaatacatttttaacagtttccctattgcagtctgcagattcaataagtggcattttaaacttcattccagtcattgccatttcaatgattttcatatggctcataatatggttcatttcccataggaacttggatgaaggcttaggccgtgttgcccgatactttgttccaaatgccttttttggttataaatga

SEQ ID NO: 1268 - DNA, 774 bp, Methanobrevibacter ruminantium
atgccaaatcaaatgcttaaaggttcagtcagatattgtactgaaaataaaaccttatttttaatcgtattcatccaatttttaatatttgaatgcataacaaataaagtgggtggaataatgaaaaccacctcagtgatagtccttttagttattttaggctatggattaaaggttactcaagacgtaatcaatggaggcaccagtctgcctaagataagccttaaggaattgctcaatttcggagtgaaaggaaccatcgtatatacattctatctgaccatacaagcttcccttttaggtttgatttccctagcaatgaatttccctgaatttgaattggaagagatgattctaaatcttcacgagaccatagaattgttttttgagcatgatcctatcagcttcatactatttatcatattaggacttctcattgtctatggaacaatattctttatggaaatcgctcttgcaatactagcagatggggaaacactaaaagcagcatttgactttaaaagaatcaaaagaacagttgaaacaatcggttggaaggaatatgctgaagactatacaaagattgtagcggctgttgttattttagtatttatcaatggatatttccactcttatggttggataagcattataataggagtattgactgatattttggcatttacagtggaatatcgtggaattggaaatatttatagaggatataaacagaagataaatcaagagacagccctcgaggatacaagcaattaa

SEQ ID NO: 1269 - DNA, 345 bp, Methanobrevibacter ruminantium
atggttgttcaagaacatatctgcataaatgaagagaaaatccaagagcatagtctccaattaaaatctcttgaatcagatgccgatttcaaagacaaaagaatggatgaattataccgcaaaatcgataagattgaagaaaaattagatgttctaaataacaatataaataattttttattgagaaattcccaggaaaacaaaaaaatggaaattaggctaacaaagatagaaaccgatattcaaaatcaaaaattagaatcccaaagaagaattgcacgaatgggaatagctctaactgcaattactatattaataaacatttatttcaagataatgcattaa

SEQ ID NO: 1270 - DNA, 132 bp, Methanobrevibacter ruminantium
atgagagaaatccacaaatatactccaaaatcagtagaaaaaaccgtttatctaaatgtatttttgggagcactgattatatcacaaggattttactcaaaaacgaccatacaacaattatctgaaaactaa

SEQ ID NO: 1271 - DNA, 666 bp, Methanobrevibacter ruminantium
atgaagcatagattaaatttagataataaagacccaaattatattttgttgaaagaaatatttaaaattatggattctagaaaatccaaaagtatattagcatcctatggatttaaaaacttaaatagaacaatatttacttttaaaattatatttataagtatgttctttggaattgacattccattcattttaaacgagcttaaatccaaaaaagaacttcgcaaatactttaatatttctgaagttttgactgcagatcaagtttataaaattttttcagaaataaactctgaaaaacttataaaatgtttaaacagaatcttaaactcaaggaatatggttaaaagaagaggaaaaaaaacttttattgttgatgcgaccccagtggacgtagatattaatttccacagaaataaaaagactaaagaacatctggaaaaaattaatctcaaatggagttattcatcctctaaaggttattatattggatttaaagcaactgttgtattagattatgattctatgaatcctgtttgtattttagtccactctggagctccaaacgatgcaaaacttttcgaagaaattttagaaaaccttcaaaaaagacgaataatcagaaaaggagacacattaatctttgataaaggatattacagctaa

SEQ ID NO: 1272 - DNA, 516 bp, Methanobrevibacter ruminantium
ttgaatgaagcattgactaaattgctagaccttatgcaggattataatgtcattctgcctaatgagttcgtttcaatggctagaggaatatccatgattgaatctgttgccaccacattagatcctaaaatagatgtcatggcttccatcgaaccgatagtcaaagaggtaatggaagaaagaatgaacattaaggaatctctttcaaacaaaaaaggcagtttggtttattataagaacatgcttaagacacttcctccacttttaacaaacagcgttcataagataaacaatggagatatgaagcttcgctttgaaattgacagaatcgaccatattgtaagcaagttttcattggttgttataattgcagcccttctgatgagctcttcaataactatgaccatcaatagagggccaatgttatttgacatgcctttaattgcagttttaggctatatagtgacttttattttaggagccatagccgttgcaaattacatatacagcagataa

SEQ ID NO: 1273 - DNA, 807 bp, Methanobrevibacter ruminantium
atgacaacaacagaatggctttatcaaattctactaaatctgcttgatttaagcacaatcatatcaattattgtaataatcatagctgcagcaataatcataaagctaggagaaaaatcacttctaagaatagagaaaaagtatgaaatcaatcttactgcccattatctcctaaaagacatccttaaatatggaattattataattgcacttgctttgatattgaatctaattggaatagaccttcaaaacatcatattgagcttaggaattgtcagtatcgtcatcggttttgcatctaaggacatcgtatccaatttcatatctggaatatttgtaattggagataagaacgtccaagttggagaaaccatagagattgacgggagaaaaggagccatcacaaaggttgggtttagaaatacaacaatgattggtatggataactttaaggtaaccattccaaactctgttctttcaaccaaaacatataaaaacttcccaatgggagaggattataggcttaggcttgatgtgatattgcctcatggatttgatatcttcgaatacaagcaaaagatgacagaggctatggaaaaatatgaatatatcaataaagacaaagaaccagtcattttagctagagaaataaatgaagaaggctctaaagttgaaatcagcttttggataaatgattataaggatagagaccctggaaaagctgtaatcttagaagaaagcaataaactaatttatgactatctcatggatgaaaagaatgcaggcatcttaaggatagttaaataa

SEQ ID NO: 1274 - DNA, 942 bp, Methanobrevibacter ruminantium
atgataagcaaagaaacatttgataaggacaaggcaaactttaaaggaacatatcgtcctttgctaaaggaaatagacaatcctacactgcttcaaatagatgaactacatggaattgcaggggcattaagcggaaaaaaccaaaacatacacaataatatcctgcttttgcttgccagcataggaaccataattacaatcatattcttcatctattttgaatgggacataagcgcctttatcataccttgcgtgcttttgatgtttatcctaataggaattcatttagtctcaaataagttgaactatcatgataaatatcttgaatacagggtcttagcagaatcattaaggcttcagtttttcctaagctatgcaggagcccaggaaaaggttatagatatcctcccttggtttatcgagcatggagttccattggttaaagaggtattgggaaccttggatttcactgaattgcctcaaaagagagaaataagggataactggattatacaccaaaagaaatatcatgaaggggctcttcaaaagtcaaaaaagaaaatgaggacacagaaaatagtcacatatgcatcaattacagtgacaatagccacctatataattgcattgatctttgaatatctcatacccgcttcaactttcaatttaaatggagatataattcatctaggcatcaaattagctatggctggaatgtctgcattcacactctttttaggaagctattacggaaagatgtccttaagcgaaaagatagatgaccatgaaaggatggttgaactatatggaattatagaagacagaataagaacagaaggagaaactgatgagatactttcatatgcagctagagagttcctgattgaaaacagtacttggtatgcgtatcaaagcaagaacaagccagatttggttgtttaa

SEQ ID NO: 1275 - DNA, 1024 bp, Methanobrevibacter ruminantium
atggaaatgaatgaaaatgttgaaatgattacaggagaccctaaaaaggcaatcaataaacttgcttggcctttgatagcaagcatgctcttgatttttttaaataacattatagacagtatctgggttgcagggcttgggcctgaccctcttgctgcaatcggctatgtcacacctctctttatggtgcttgtaggatttggaaacggtatcggtgcaggtgcaacctcacttatctcccgttatatcggagctgaaaagagggatgatgcaaacaatgcagcgattcactctgccatattaagtgtggttgtttcattggttctcactgtcattgcccttttgatattagagtccttgcttaagctaatgggtgctgggtctgtattgaaatatgcaatggactatggtgtgattatatttcttttcactgcccctatattgatacctcctatatttggtggtgctttcagggctgaaggagacattaaacgggcaactgtgcctattgcacttgttgctgtaatcaatatgattctagatccgatattcatgtatgtatttggctggggaatttcaggtgctgcctttgcaacaggtcttgctccatgcttcggtctttgcatgatgctctattggatattcattaaaaaggacacttatctctcatataatagaaaggatttccataataatttgaatatgtataaggatattttagttgttggaatacctgcaagccttgagcagttaatcatggctgcacttgcagttacagtcaattatatgctcacccttgtttcaggttcagttgcagtggctgtatatactgcaggatggagaataatctcattaggactcttgccagctattggagttggaactgctgccattacagtcacaggtgttgcatatggtgcaaagaaatatgaaaacataaggactgcatgcagatattcagttaagctaggtctcatatcctctattatagtatgcatattgctctttatatttgcagatcaga

SEQ ID NO: 1276 - DNA, 573 bp, Methanobrevibacter ruminantium
atggattttatttcaactctactgattgcaatcgcacttgcaatggatgcctttagcgtttccctaacaaagggattcaccttaaagaacctcacaaaaagccaagctttatggtttggaatattctttggtggatttcaggctttaatgcctgttctcggatggctaggaggaatccaacttgaatggctcattacaacctttgcaccttgggttgcattcatacttcttcttttaatcggttcaaatatgattagagaaagtctctctggtgatgaagaggatgagaaggactctgataagttttcatttaaggaattgacattgcttgcaatagctacaagcattgatgcatttgcagttggaataacatatgcagtactaaaagtagatattctaattcctataataatgattggagttgtagcatttatctttacaataattggactttatttaggtaaaaaaataggaaattactttggagacaagtttgagatagtcggtggagtgatcttaattcttcttggtgtaaaaatactccttgaaggtcttggaattttagttttataa

SEQ ID NO: 1277 - DNA, 960 bp, Methanobrevibacter ruminantium
gtgagcagcactaacactgctgttgaaaataaacaggaaagagaagaagctttcttaaaacaaacttcaaaaccaagtttctctaaaactgcaacagaaggatttaagcaaaaggataaaggaataaaaaatcctgctacaaaatataatatgcctaaaaaagaagaaactgttgatgctaaagctaaggaagctcctaaaagggaagctcctaaaaaagaaattaaaagggaatcccctaagaaagaagttaaaaaagaagctcctaaaaaagaaattaaaccaaatattgttaaaaaatcagatgaaggttcatctggcggaataaaccttaaaaagattggaattatagcaataatcatactaatcattcttttaatcgcaggaatcggacttaatcaaatgcaaaaccagacaactgatgaggtgatgaactatacagacggcatcatcaatttcacctactctggtaactggtctgtatacaacaataccaatgcagattccaacatgaccgatcttgcattcaaaactaaagataaaactttaattggatttacaacaattcaaagcgatgaaatcacttatgaaaaaatcctatcagatgtaaatgacactgcccattccttaaatggagaaatccttgaatatcaagaggttaatgtgggaggcgtcccagctcaagagataatcataagcactcaagatcaaggctattccagatacctatgcatcttgcatgacggagtctactattgcttcgttgcaaacaatgcaaaatctgacaatcagaacttgacatctttgaatacaactgaaattcaaaatatgattaatagtattagttttaaggatgttgtagctggagacactgcaaaccttgatacaagctatcaggaaagcagttaccaagaggaaagctacgacaactataactatgaagacacaagcaattactaa

SEQ ID NO: 1278 - DNA, 765 bp, Methanobrevibacter ruminantium
ttgatttttgcagcaatctttgctgttggaatattgctaagggataaaatagtccataagctaaatttctttgtaaatcctcagaattatttgcctgaagaggaaatacaaacattgaagcaggtttattatttgattttaattctaattttagttgtgtgtattctaaacttcttctttgacaataatatcatattgccaaacagtccggaattctatgtattcaattcctttttagatattatagtttcagtatatatagcaataatcatttatgacggctctaaaaaaagcaaaatattattgatattcctaattcctattccatcaattgcattcctattatttggcgaatctttaattgaatattgggattttgtacgtattcctgcattattatatattatgaagatattttatgataagttccatatttatactgataagtataatttggaaaaatcaatacttcttctcttttcaatagtgttcattagttttattataacattggttgctgaaaacgaagatccattaaacgcattggttatggtctccaatgcatttacaagcaagggatatacaattttaggtgaaagcactataggaaaaatagatagcatatttctagtttggggaggttatattatatctggagctgctacagctactttgactgctgcaattttaattaaacactttaatgctaaaatagagaaatttgatgaaaaatttgaagaattagaaaagttaatttccgaataa

SEQ ID NO: 1279 - DNA, 420 bp, Methanobrevibacter ruminantium
ttgtatttagaattttggataattttagccattatcctcataattggagaactgctgacaggtggattctacctattatccataggacttggatcgctagctgctgcaatatttaactatttccaatttagcattacaatccaaattgtggcatttattttagttacagtcatttttatcattctttctaggcctctctttaatcggcttaatagaaacacaattgataaaaaatcaaacacagagcgattgattggattgaatggagaagctatggaagatattgggcaaaaaaatattggagcaataagcataaaaggagaagtctggaaagccatttcagatgaggagatatctaaaggggaagaagtaaaaataataggtatagatggagttaagttaaaggttgaaaaactctaa

SEQ ID NO: 1280 - DNA, 969 bp, Methanobrevibacter ruminantium
atgatggatttaatttacatattaataataattatcattgcaataatcgcatacaaaagcataaagatcataagaccttatgaaaaaggggttgtagaaagattaggaaagtacaaccgaactgtagaaagaggtctgaacattgttattccatttatagagacaatcagaaaggttgacttaagggaacaggtcgtagatgttcctcctcaagaggtaattacaaaggacaacaccgttgtagttgtagattgcgttatcttttgcgaggtcatagatgccttcaatgcagtatacaatgttgttaacttctatcaggcaattaccaagcttgcacaaaccaatctaagaaatatcatcggtgacttggaattggaccaaaccctgacttcaagagagatgatcaatacagaattgcgtgaaacccttgatgttgcaactgacaaatggggaacaaaagttgtccgtgtagaaattcaaagaatagaacctccaaaggacatcgttgaagcaatgagtaaacaaatgaaagccgaaaggatgaaaagagctacaattctagagtctgaaggttataaggaatctgaaatcaaaaaggcagaaggggacaagcaatccaagattcttgcagcccaagcggaagctgaagccataaagcaagttgcagatgcaaacaaatatcaggaaattgccattgctgaaggtaaggcaagggcaaccgaaatcacctataatgcaatccatgcaggtaatcctactaatgacctgattgcaatcaagtatctggaggctcttgaaaacattgctgatggaagagcaactaaaatattcttgcctactgaagtttcaggaatcttaggctcagttggaggaattgcagaattgtttaaggacgatcctgaagcattggaaaaatttgaaagtataaaagttctagaaaatgctaaagaaacagcagataatgaatag

SEQ ID NO: 1281 - DNA, 390 bp, Methanobrevibacter ruminantium
ttgggaggtgaaaaaatggcaaaaatgaatgctgtgatattaggatttatattgacacttgttgtttacctattctttggacgctatgaattctggggtcttttaattgtaggattcattgtaggatatatagctcacgaaggaatattaggcggaatgtggaatgcagcccttgcaggagcattcggaacaatcatatcagcaatcctattcataatacttgtcacaattggaggaactgcaatgatgggattcctcggaggacttgctggatttacagtttcaggaattacaagcttgattgatattgtatttacaataatcaaatatatgattgttatgggaataactggtgctgtaggtggagccttaagcggagaaaaagaataa

SEQ ID NO: 1282 - DNA, 513 bp, Methanobrevibacter ruminantium
atggtagatgcagaaaaagcaaaacaacctaaggagagaaagaataaaaacagtaaccttccagatattgattttaaagcattaatttttggtgcagcagcatatgcatttttcccgcttgttgcataccaatacaatctagacattttaatggtatttgcagcaataggtccattatacataggatatactgcaaaaactgaacttaaatcaatcattttaggaattgtaggtgcaactccactattatatttagctttttcaggcatgttaggatcatacggatcaggtgaaatggcagatataatcatgactgtcggaattctcggacttggcgcattgatgggatactttggaggatacctctacagagataggcaaagaaataaagcaaaagcagggggtattgtagtcgaagacactcctaaaaaagaaaaacaatttgaagacactggaagtgtcaaaaagaatgttgctaacttattccttccaaaaagcagaaggaaaaaataa

SEQ ID NO: 1283 - DNA, 1024 bp, Methanobrevibacter ruminantium
atggccattggagttaaagagattagaatcactgataccataagtgttttattattgcctttaatatatgccctaatcatgggtttggctctttttttagcaaaacctataaaatttataggtaaaaagcaatcaaaggtagctgaaggagcaatggttttatttataggagttttaattgctaaattagctatttcgagcggacaatccattgatattatttttaatgtcggcccctccttgattttacaacttttgggggatttgggcactcttatagcattgcccgttgctttgattttaggatttagaagagaagtaatcggtatggcaagttccatttgccgcgaacctaacttgggagtcattatcgacaagtatggtttcaaatcccctgagacaaggggagttttagccatttttgttataggatccattatcggcactccttttatcagcttcctatcaagcatatgcatttcgctcataccttaccatccatatgcctttgcaatggcttcaggcataggaagcgcaagcatgaatgctgcagcattggttccattggtgcatatgtaccctgccatggctacccaattggaggcctttgcaggatgcagtaacattctttcattttgtttaggcatttacatgtgcatattcatttccctgcctcttgcagaaaaattgtataaatggttatctccaatcataggtaaaggtgaggggagaaccattgatgacgaatatgctattgaaggagtaaaagatgataaatatgctacttctgaggatttgagttctggtaagattgaaagatgggtcactttcctcgtacttttctcaatcatcggcacagttggaaatttcataggttatcatacccctttgcttgatgtgttcatcggaatgctaatcatttcaattattacccttatcggaatgtgccttgagaggataattccatgggatatcccatcaatcatttatataagtttacttggtatttttttagccattcctg

SEQ ID NO: 1284 - DNA, 1024 bp, Methanobrevibacter ruminantium
atgaagcatagattaaatttagataataaagacccaaattatattttgttgaaagaaatatttaaaattatggattctagaaaatccaaaagtatattagcatcctatggatttaaaaacttaaatagaacaatatttacttttaaaattatatttataagtatgttctttggaattgacattccattcattttaaacgagcttaaatccaaaaaagaacttcgcaaatactttaatatttctgaagttttgactgcagatcaagtttataaaattttttcagaaataaactctgaaaaacttataaaatgtttaaacagaatcttaaactcaaggaatatggttaaaagaagaggaaaaaagacttttattgttgatgcgaccccagtggacgtagatattaatttccacagaaataaaaagactaaagaacatctggaaaaaattaatctcaaatggagttattcatcctctaaaggttattatattggatttaaagcaactgttgtattagattatgattctatgaatcctgtttgtattttagtccactctggagctccaaacgatgcaaaacttttcgaagaaattttagaaaaccttcaaaaaagacgaataatcagaaaaggagacacattaatctttgataaaggatattacagctataaaaactaccaaatcggaatcagcaaatacaaaatcattcctttcatttttccaaaagaaaaattcagcagaacccgattggatgacattttaacttatccactagccgtatttaacaaaacaaagagaataatgaaagaaaaaagattatacaacagtttaaaaatggaattaatgaaaaaaatagattcatgggaaaaatttaaaccaataaggggcaaaatagaagattttttcaaattattaaaacaaggcttgaatatgagagaaatccacaaatatactccaaaatcagtagaaaaaaccgtttatctaaatgtatttttaggagcactgattatatcacaaggattttact

SEQ ID NO: 1285 - DNA, 315 bp, Methanobrevibacter ruminantium
atgtttgtaatatccttgattccttatttgacaatttttgttgctaataatccgaattctcttttaagcgaatccttatatggtttggattttattttggtggatattattctatttattatgagccggtatctgataaaaataaatgagaatagcgaatatttgtctgaagttttggatttgaaaaatgcaataattattccattcattttcctaattataggattcattataggttttttaggctatcctattgcaatcagcattgtctgtttgattacaatcgtaaggtcaatattatattcaattaaatag

SEQ ID NO: 1286 - DNA, 228 bp, Methanobrevibacter ruminantium
atgaaaatggaaaacttgatggaaaccaataggctggaagctttttatgatgcgataattgcaattattgtaacagttttggttttggaattgccacagcctgaaaccgctaccattgcaggaattttagctttgaaagtttcatatttcacttatcttgtcagtttccttgtttgccaatctctggcaatatcaccacttgatatatgctcatgtgaaaaaaattga

SEQ ID NO: 1287 - DNA, 474 bp, Methanobrevibacter ruminantium
atgagcataattgcaatttttctaggaataatagtcattgcattccctcttttaggaattattgcagcatctgatattcttggactatcagtcttattgctttcaattttcttgctcttaaacggaatatctgaagtggaatataacactacaaaagggcttttaaataccattattggactgataatgttggttgtaagcttaggattgatattcaacccaagcatattttcattcttaaccgctataaccatatatctagcaggaattttcttgataatcattggattggttgtgattgttggaaacagggaaaataagtataaattctggatgggaattattggaattatcttaggtgtaatctatataattcttggaacttatatccacaattcatttgttctcggttcattgattggaatatggctagtggctactggtatattaaacttattaagtgacggttattaa

SEQ ID NO: 1288 - DNA, 1024 bp, Methanobrevibacter ruminantium
atgaacgccaatccaaaaatacttctttacattctaatgatttcagcccttggaataaacactccattaagcattgtcggaatcatctcacaaatagcagagtatttcaatacatcaatagccatttcaggactctatgtaagctcatttacatttaccatagccatatgcggattgttcatacctgttttattttcaaaatacaatcgaaaaagaacctttgtaagcattttaacagtgtttgcaatatcaaacattgcaataatctttacaaaaagcatttacattgcctctttctttagaatattatcagccatattttatccggcattcatatcaatagcccttacagtttgcgaagaaatagccccaaaaggagaagaacaagattatattacaaaaattctgcttggaatatcaatcggaagcattgtaggccttcctataacaacaggccttggaacaatattcaattatcaagttgcaatgtcatggatctttgcaatcaatctattatccttaatattgataatcatattcttcccaaaaatcaaaggcaaggctaaaagttatgaaatgccattttccagtcttaaatcaaaggaattccttcttgctacaattggaataatgatgatgccaataggagcaagcatagtatataattaccagccatacttcctgcaggtagtcagccatgtctacacatataaactaagcatattcctattcatttatggactgttctcaatatttggaacttggcttggaggaaagttaatagctaaaagagacaaagcaaccattctcattttccaattaatatgtggaggagtgtttgtactcctttatctatttgcaaattatctgattccagtcctaatattgattctaatatttggaatcttagacggaatgggctacaatctcatccaatacattgaaagttcagtaatcccagacagcccagaacttgcaaacggagtgtttttaagcattttaaatggaggaatagctcttggaa

SEQ ID NO: 1289 - DNA, 357 bp, Methanobrevibacter ruminantium
atgaatataaatggtgatttgatgaataaaaaaattactgtagacatattaatgttcatagcaataatagtggaatttctaagcctgcctattctaattcatgaaatagttggagtgggattattgtttttaattgcattacacttaaaatataacaaaaggtattttaaaacaataggcaaaggaaaatataaccttaaaagaactctaaatcttatcataaacataggattgcttgcttccttattgataaccataatttcaggaatcttctctagccaaaagtcattaaaaggcatgaagataggaaatcacaaaatttcacatattcataaatcatcttcatatttagtctaa

SEQ ID NO: 1290 - DNA, 744 bp, Methanobrevibacter ruminantium
atgggtcctgattttataatatccattttcaaagggggagctgaatcattaaacacttcaatgaacatattcttcaccgatctgattattattgcattcattccttcattgtatattgcatcaaagattgttaaggacaggcccttttcctcctattcatcttcacgagggggatggaacttcagactctactttaaggcattggcaattcctgtaatattgtatataatatatttgggggcagaatctctcattttaggatcagaaggcacatctcatttctcaatagcctttcttgctgtgcttttgatttccgtgcctctccaatgtattgcagaggaatatatatttcgtgggattatcatgcaaacattagggtcatggattgggatacctcttatagccatagttattcaagccataatatttactttgggccatggatatgacgccctaggactccttgaaacattggttttaggtattgcctatggattttttgcctggaaaacaaatgggatagagataagttcagcccttcatactgcgaataatttttctcttggcttattcatcatgcttggactggaagcatcaaattcctctttccaattatatgataagataggaggaattgtctatttaataatattatgtataataatgtattatgttggcaagaaaactgattggtttggtgaaatcccagaagactctcaaaatataggattattaaatttttaa

SEQ ID NO: 1291 - DNA, 984 bp, Methanobrevibacter ruminantium
atggcaggacttatctctggaattgttgctttgttcacctcttggctaggtgtctctggaacagtcatagggtctgttttcagctcatttctttatcaattcctttcatcctactctgctgagaagtatgaggagcgagttggggaaggaacttcaagaaagcctagaaacattggcagcgaaatagtctatatatttccaatagtggtcatagttataatagaagtgatcttcatactctctgacatgcattatgtatttgataagatctttgacattcttgagtatgggatattccagaacaatctatttaggttaatgggtcttggtcttattgctttaggggtttatccattgttaagctcaactaacattgaaaagatcaatggtgaaatcgttttagttgcaggaatatatctcttcatcagaggaatggtggatataaatgacttgaccatgcaagtgcataacatgttctttgctgattttgacttttttattgcaataatagttgttttagcccttgtatttgtaattttcaatgttttaagaaattctacacaggaatactttaataaggaagatggagattatgatgcagtgaatgatgagttcactcaaaaaagattctctaagcctagaagaaaatcaaaagctcgcaagattgacaccagttccttccataagggccaagagtataaagagcattatctaaacagtgattttaatgataagggtcataatcagagtcctaaccctgattccaatatggatgattatcataatgatgatttaaataattatcaaactcctcaagaggatttacctatctatgaagaggagattatttatctccataatccggaggatcctaataatccaataaagaaaagaatcttaaaaagagtcaatcctgattctcattatgatgatgactatgatgagacttatataattgatgatgccaaaaacgacaatttttaa

SEQ ID NO: 1292 - DNA, 792 bp, Methanobrevibacter ruminantium
atgaaaaaaccagggattttaaataaaattacaattattgacattctaataataatttgtatcattggagcagtgggattcgcagtttaccatatggttgatgatgactcaacaaaggcttcagctacctcctttgactattcaacaaacaataagatgcttgaaacatatatgaattattataaagatggaaaaatagttacaagcagccttattggaactaaatcaaacaccggcgaaaagattgaaatgaacggcacagtcctatggcttggagacaatcaaaacgataaggtaaacattgaaattaacaatgacggcaagcctatactcgctggtttctacaaagacacaccaaatgcagatgtctttattgaacagataagcctagagacaaatggagacagctatgcaaacattacagactttgtagtcagtcctaaagagattaagaatctaaaggaaataatatctaaaattcctaatgatacagaatatgaaatcagtacaagcatcgctatagatgacctagatagcgttactgctcaaaaattagcaaatgcattaaataaaaataagaaaccttgcattgtcttaaagaatagtggaacagtcatacttgaagtcaatagagccaatcagactgattttgaaatagctgacaatgtattaggagactttaaaggacagacaagcgagatacaaattagaatctataattctacagcacaagattccatagacattcaaaatgcatttaatgttttaagcattgctaatacaagtcattaa

SEQ ID NO: 1293 - DNA, 1024 bp, Methanobrevibacter ruminantium
ttggaatttattgaaaatcaatgggtcaacagttattttaagggcttataccctagcgaaagattcctatcaattgtaaataagagtaagatcttaaaggaagagatattttcaccccttattgttttagtcacattcactctttttatacttcttgcaactgatccggtcccaagggatttgcagaccactataatcattgcttttctaagcttttttattggtgcaataatatttccaagatttattttgaataatcaattaaatcaattaaatgatgaaactaataccgacaataaagaatcaaagactgataaaagcaagcaaattcccttatttaattcctacgatgtatattcaataggattctgccttagcttaattggaattgtctttttgtttttaagcattgcctccgttggagggctgccaatactaaagtcctcattaagatattcacttaagccagcatttacaatgcctgtatttttaataattccaggtatcggacttatggcttcacattatctaaaccagtacaagaataatgaaatcagccgcagccaaacaagattcagattcttggttttaactgcaattggaattggaactgtccttacactccaatatagaaccccaatcattgccattttacttatgatgattataataggatattatggtaaaatactatcagtttgggaggtcattttaggtgccctgcttggagtatgtgccatcattggaattggatatttaagatcattgaatgagcttgcaataagctcaaatacaaatatattctccaccttaaactcaagggcaaactttacaatgcatgtattgaacctactgaattatatttcagggaatttcggactaatgcatggaaagatgatagcaagcgccatgcctggaagcgatcttggacctagaatgatggtgggcaaactgatagcttggagaacagaggttactgtaacccctacattgctaggacagatgctagtggatttcggaaaac

SEQ ID NO: 1294 - DNA, 831 bp, Methanobrevibacter ruminantium
atggcaatagaagaagttagaaatttggaagtgatcgcttctaaggacactatcattcataatttggaaggtagggttaagcttattgccatcttattaataatcgttttctgtgttttttcagataggctaatagttccacttgtattggaaatattcttgctcattgtaatgtatctggctgaattgtcctttaaggacagctttaaaagaatagctcttcttttgccattcggtggttttgttatcgctttccagccattcatccaccctggaaatatcatttggcaaggtccttatccttggttgtttataacagacactggtttaaattggacagttctcttatttgctagattaatcgtctgtttgacagctattgtcatcctttcatctacctcaccaatgcaggaagttgttcaatcatttagaaagcttggaatgccaagagatcttgctatgattttaacaattatggtcagattcctatttatctttgtagatgaattaagggacatcagacagtcaatgaagtctagaaactttgatcctttcaataagaagattccgtataaatggagagtcaagcaggtgggatatagcatagcgatgatgtttttaaaggcatatgaaaagggagaaaccatttatttaagtatggccagcagatgcttctcagacaattccagattatatcatgccaagactataattggaaagcatgagtatatatttttagcttgtgttataggcattgtcattgttttagaactggttgtattgttctattctggcaatttggattatttaggcgtttctttatctttataa

SEQ ID NO: 1295 - DNA, 570 bp, Methanobrevibacter ruminantium
ttgattattgcattgtatttcgctggaaaatgggccaaagcaaatctagatgaaaaacgtataccacttcttgcagtattagctgcaggtatttttgcaattatgtctatgaacatgcctattccatttggtaccagtggccacatggtcggtggggcattagttgctattgtatttatggctcctgaagctgctgttcttgtattcactgcagtattgcttatacaagctttattcttcggagacggtggaattaccgctttaggtgcaaatgtatttaacatggctatcgttggaggatgtgtcggtctttacacctacaaaggattaaacggcatcattggaaaatatccttcaatattcttaggcgcatggcttgcaacattagttgcagctgttgtctgtgctcttgagatggctattgcaggaactttcccattgagtgtgggagtcgcttctatggcactttaccatgcattcattggtttaattgaaggagtattaacagttattgttatatttgctcttgaaaaatacagaccagatctattggcatggaatagagaatag

SEQ ID NO: 1296 - DNA, 1024 bp, Methanobrevibacter ruminantium
atggcaaatctcaaaataggtttagcaggtaatcctaatgtaggtaaaaccaccctattcaataatttgaccggtttaaaccaacatgtaggtaactggcctggtaaaaccgtagcacaagcaaaaggttcctataaacatagtgggaacgaagttgaagtaattgatttacctggtaactatgctttaagtgctcattcaattgaggaaattgtatcaagagactttatcgtagatgaagactctgatgtaatcgtgaacattatagatgcagcaaacatagaaagaaacctgtatctgactgttcagatgatggagctcggagctaatttagtagttgcattgaatatgaataagtacgcccaagacaagggatatacaatcaatgcagataagctttctgaattattgggagttcctgttgttgaaattgaagcaaatagtgatataggtaaagagcaattgcttaaaactattgaacaagcagctgcaaacccggtagactcttctaaaaaattggtttataacaatgaacttaaagagcatctcgctgaattgcaggctgttatagaagaagacaaaaacttacttgatgttccttcatcttggattgcaatcaaattgcttgaaaatgatgaaatcgttgaagagaagattgaaggatcttcaaaaagaaacaatatagtaaatgaaactcaaaaggtcaaggaccacttgaaaggcatatttggagaaggcagtgaagaggtaatcgcaaatgcaagatatgcattcattgacggattattaaaagaatctctcaccaagccggaccatttgaaaaccactataagtgaaaaaatcgatagaatcgttacaaacaggatattgggcttcccgatattccttgttataatgtatgcaatgtttgaaatcgtatttactttcggcgcacctttccaagatttgattgacgaattctttggaatcttaggtgatgccataatcggctcccttggagaaacaatgctttcttcattcctag

SEQ ID NO: 1297 - DNA, 279 bp, Methanobrevibacter ruminantium
atggtagacagacatgaaattgtagacaaaatgtatgaaaacaaacacactttacttttcgtaggaggaattgcaactgcaattgtaggggcaaaaattttaaaatcccaaaccactaaagattacgctgcaaaaggaatggctaaagttctaacttgcaaaagcgacttagaagaatccattcaagacattaaagacaatgcagaagacattcaaactgatgcaaaagctgctcaaaaagaagcaatctgtgtagatgtaactgaagaagaagaataa

SEQ ID NO: 1298 - DNA, 408 bp, Methanobrevibacter ruminantium
atgaataatcaagattacgatactggaataagttcagaggtttttacagtcaaatcaaatatcaaattaatagatatttttaatttgattttagaaaagaaagcaagggctgttatggacttatttgatagtctaacaaacaaggaaacaatacataatgaaagttccatcataattattggaacctattttacaggaatagccattgcgaaatatttatcatataatggttttaaaaatattactatagttgatatttatccccatttggaaggttttattgattctaacttgggagatcctattgatgtgaataaatcttctaaaggtaaatttaaagagaatatagaattttcatcagatttgggcttaataagaagtgctgatgttgtaattgacactacttga

SEQ ID NO: 1299 - DNA, 609 bp, Methanobrevibacter ruminantium
atgttttttatattgtttgctttgtttatcctttatcttcctaaaataagacatgagaatgattattcatcaatctcaaaagaactgccctatgcattgcgccaattgtccactgaattaagggctggaaaaagcttgtttgatgctcttgattctattgttgactctgactatggtgttttatcaagggaattttcaagggttcttgaggagataaaatatggtgaaacaagtgaaaatgcctttttgaatctggagaagagggtaaactccaaggcattatctagagtaatctatgagatacttgcaagcttaaggatagggaggcaatcttgtcccattcaattaaatattattgctgaagatgttaattttgatatgagaatgaagttaaaggaatatagtgaaaaattaaatgctttcattatgatttatacatttttagctattttagcgcctgtgattattttaacaatgcttcttgcagcttctgttgtaattggagatattgttccaagcagtctgctttttattctgtatggattgttctttccaatgataattgtgtttttagcatttgcaattaagaaattagagcctaagctgtga

SEQ ID NO: 1300 - DNA, 1024 bp, Methanobrevibacter ruminantium
atgtttgatctattagcggcatgttttattggaatagcaattggaacaggtacaggaatggttccaggcatccatgtaaacactgccggagcaatcatgtttgcatcatcaggatttttgcttagtttcttatctcctgaatttttatgtatagttatggtatcaatgagtattgctcacgctttgattgagtttgttccatcaatgcttcttggagttcccgaagagggcactgcaagttctattcttccaggacataggatggttttggaaggaagatctaaggaagctatcagaatagtttcagtaggcgggtttggcgctattgttgtagtgatattaatgttgccaatatttgcagtggcattgccatttctgcaggatttatcaaagccttacacttggatgatacttacggttgtttctattttaatgatatataagttaagcaatggaaggctcgcatttatgtggtctatcttgttatttgtattatctgggattttaggttggataatgcttcagacccctatatcttcaggaatttcattaatgtgcactttcagtgggttatttggaattagcactattctttttagcttaaatgatagctcttcaattcctcatcaaaataaatactacgatttcgtaatcgataaggatacaataaagagcattttcgcaggaggcactgcaggagctatcttaggctttttaccaggttttggaccagctcaaggaagcattattgcacagggagtatgtggaacaagcgcagatggggatgacactaaaaattttcttctagcaaacagtggattgaatacttcagacaccttattttccctaatagcaatctatctgataggaaatcctagaagtgggattgcagtgtatatgtcctatttgatatctgaatttactttgtctcatttgatgatattcacttttgcttctttaattgcagtttcaatatcattgattatttgcttaaagctgggagacggcttttcaaacctaatgc

SEQ ID NO: 1301 - DNA, 1024 bp, Methanobrevibacter ruminantium
gtgacaacaatattttattttgcgctttctcaaacctttataactcaattaggattagggagcccacaaataggattattatacgtttttggcctattatttggcccttttggtgcattaggtgcatcattatcaaacgtagcaatagatgtttatcatggatatacctttgttcaaatactcccttcagccatcatcagctttggagtttctcttttggcatataagctttggtactccggatttaaatcagatgagtatacaaaaccaagattggatacaatttaccacctatgcctatttttagcaagcataatcatatgcggaatgatttattcagtaggccacggaaatctggcatatatcctaatcagcccagatatagaggaatcaataatcattccatccttcttgaactttacaaacgttgcattcattatgggtattgcaggaatttggctttttaaaagaacaaatctcatagagacccctaaaaaatcagagcgtcgattgaacaagaacctataccgtttgatcttttccttattaatggtcatgacaatagtctcattcatattcataattagaaattcagataatctcacaataatcacaggcctaataatagttgtggccctaatgtatgcctatatgacaaagccattcatacatgagatacaagaggtcaacgagaacagcataattgcaaagattgtccgcaatttcattataattaccctaatccttggattctttggagggctcgtttccatagccagctttgactatgttgaaacaagcattacactcaacatctacctccatctgatgccgattcttgtgataagcgacataatcataattctcttcttcattccaggaatcattatccttaaatacattggagataatgtagtcaagccaatcacctcattttccgaaatcgaaggattcatcaaggaagatgaaaagatagaagcggaagggctcattaaggtctattcagaatatgtcaatgaacaga

SEQ ID NO: 1302 - DNA, 1024 bp, Methanobrevibacter ruminantium
atgagcaagaatagaattgaatggattgatctcgtaagagctctcgctattttaaccgttctatacattcatgcaacagatggaatctatattatctcctctgatttaatcccctattggactcctttttcaagagttttccaattcatatcactttttattggacgtataggagttccattcttcttaatgattacaggttatctattgcttgatagaacctatgacgatgagagagtcaaaaagttttggaacaagagctgtaagggcttggtcatagttacaatcatctggtccctgatttatgcagtgagcatacagcttgtggcctattccagcatacaagtcaatacaatagaagctggaaacctattcttcagccatatgtggtatatgccaatgattatcggtatgtatttatccatgcctttcgtagcgaatgcattgaaaaactttgatccaagaacaattaaccaagctacaatcgtattctcctgcctggcattcctgctgcctttcatttcgattgtatgtgagatgcaagggcttcagaatgtaaacatccaatactgccttggtttcagtggaggagtatatggtatctatatcatactgggttggctggttaagaagggactattcaagaagtattcctcaaacagcttgaggctgcttgcaatagtttcgtttataatttgcgttctcttccaatggtatgcattctctatagacttcagtttctcattatggtatgagttcccatttatcctaaccggatcatttgcattgtttgaattatgttcaagaagagaaaaggtcagaggatttagaggagttgaatttttagccaaatattcatttgctgtgtttttaatacacaacctgtttagaatcatattgcttcctatggtggtttacctgccatatacagaaccggttaaagcgattatactttggatacttttaataataaccagttatgcagctgcagttattatttatagaattcctaagttcggtaaat

SEQ ID NO: 1303 - DNA, 711 bp, Methanobrevibacter ruminantium
atgaattatttaaatcaaaattatgccactgtctttatgggcaatgactttttattgataattgcctcgttaatcataatgattttcatatttggatatggatcagtcataacaaaggatgtgataagagggggcaagaaactgcctaaaatatacattaaagagtgcaccatctatggaattaaatgtgttatagtggcactcatatactctgcagttcaaaccttagttatggttgacctttcccatagattcctttttccagaatttgaattagagcatgcccttacagatataactggaacattacaaatgttcactgcaaataatcctatattgattggcgaatatgttgtaataagtataatattaacctatatttttgtgttctttatggaaatttcacttgcaagacttgcagatgggggaaaattgcttgaatcatttaatttgcttgcaatcaaacgatgcatagacactataggctggaaaaaatatacaattgattatacaaagcttcttcttgcaataactattttaacttatctccaatatggattccaattcttaggattcttcgattacataacagatttgatttttggccttctagtcttcataatccaatttattggaattgggcaaatctataagatatataaaattaaaaaatatagcaatctggataggccgacaaaaaagagtgtttaa

SEQ ID NO: 1304 - DNA, 906 bp, Methanobrevibacter ruminantium
ttgttgcttgaactaataattgaaaacttactagaaaccattgcaagcatcatagtttttctaattccattaggaataggaaaatacattatgaataaaataaaaaagcatgaaagtaaatttacaaacaataggctacttaatcccgctgaatatatgccaaaagaggaagttgaaacattaaagcaagtatcctatttaatagtgctatttttactcttcatattcttcatatacagtttttggccaatggcaaatatgaaattcttctcatttttagaaattgtattgatggtatacattgcattaaacatagactatagcaactggaaaaacaaggtactgtttttctttttagtgccttatggatcaatagcatggttcctttttgaagaacttacaaacagcctattcgacatattccatatgataattcttttatactttatgaaagtctattatgagaagtttagggaatatactgaaacaaatggtttaggaataaccatattgctattatttaccataatatttattagttttattttaacaatgattgtagaaggagtctcaccgatcgattcaatagcaatggtctcaaatgcatttacaagtaatggatatgcagttttaggaagttcattcggtggaaaattaaacagcatactattggtttggagcggttatatcctttcaggagtaggtactgctacaatgacagttgctcttctttcaaaacacttcaataaaagaatcaaggaaaatgaaaaaacaaatgaagcacaatatgccgaattaaaagagatgattgaaagaaataatgaggaaattaaagagatccttaaagagaacaatctggaaaaaaagactgaagaagaattagaaaagaaaattatagaaccgtaa

SEQ ID NO: 1305 - DNA, 597 bp, Methanobrevibacter ruminantium
atgcttgaaagtttaagaccatttctcacaaaaatattagaacctatagccagccgattaaatataaatccaaatattgtaactataatttcgccatttttagctataatatctgcatatttctttgctacagggaatttgattggcggagcattattcatacttcttagcggatttttagatgttgttgatggagctgtagcaagataccacaacagatcaagcccatttggtgcatttctagactctacaatggacagatttgcagatgcaatcatattcattggaataatctttggaggttattgtaattggtttgttggagttttagcaatccattcagcaattacagtaagctatgtaaaggcaagagccgaatcacaaggagttgagtgcaatactggaatagccgaacgtgcagttagattgataattcttatggtgggagcggtaattgcattcatattcaattcagatataattttcacatactttatctacatacttgtagttctttcatactttacagtaggccaaagagtttaccacgtctggaaagagctaaataaaaagaaaatcccacaaagaagattgtag

SEQ ID NO: 1306 - DNA, 378 bp, Methanobrevibacter ruminantium
atgagtttttgtccaaattgtggagtggaacgaaaagaaggaagtcatttttgccatcattgtggctatgattatagagaagctaattcatctgggatgggctctagttctagttctgattcacaagtaaatcagaatcctagttttaattctcaagtaaatcaaagttctacttataatgtcccaacaaagcaaaatcctcataattttgctaagatcactggttatatattgtcctttttaatacctgtatttgcaatcgtaattggtatatatttgattttatctaaaaatgaggaagttcataaacatggaataattattatcggaatttctatagttgttcaaatactttctatgatttttatgatgggttaa

SEQ ID NO: 1307 - DNA, 522 bp, Methanobrevibacter ruminantium
gtgattacagtgattgtccttgagattccaatggctgtagatggatcttggggagctttgcttgatataaaattggaatttattgtttatgcagtaagttttatcgtttgctttaacttttggaattataacaataatgtttttagcatggtaaataagatagatcataaggttatctggtcaataggcattgcaatgtttttcctatctttaattccttatttgactacattcgttgccttaaatcctgatgcattcttgcctagcttcttatatggtttggactttataatcgttgctattttgacaatttttactataaatgctttaaagaattcggataaggcaaatattgctcttcagatagcattggcagataatcagccatatgttacaacaatcgtatttgtattgtttggaatgatcgttggctattttatttatccattggctattgtgattgcatgcttgttttcaataattactctatggttaatttcttattataaaaagcatggctaa

SEQ ID NO: 1308 - DNA, 567 bp, Methanobrevibacter ruminantium
atgaacactaacagatttgaaacattttttgatgcgattatagcaatcataatcacagttcttgtattaaagttatcacagcctgcagctcctaccgttcctgcatttttagccttaaatgcaaggtttataacttatgcaatctgttatttggccctttttatcatttggtatgataatcataatttattccaggtagttgaagagataaataatactgtattgattatttatgccattcagatgtttgcaatttctcttcttccttattttgctacttgggtggcattgaatgtgaattcaattgctgctgagacaatgtttggaatcgattttcttgcaatacttattctttatgtattgtctatttatgcggtttatagggctgacccctataattgcggaatatctaaaaacaatttcagaaagatctattgctatattccgattataatcgttcttatagggatttttaataagctatacagtttatactccaggaatatttgtctgcattctgattgcactgatttgctggcttttcttttcaagacttcaaagacctga

SEQ ID NO: 1309 - DNA, 627 bp, Methanobrevibacter ruminantium
atgagggattgtagcaattgcaatagggaatcttgccttttgcagaaagtagcaggaataataatggtttttggcagcttatactatattcttgctgaattgatttcagcaggatttttcaatgattccttaatcaacacctatctttttcataccatttcagaattgggagttcctgtggccaattctcctttatcctttttaatgaattctgcttttattctaattggaattactcttttattaggttattttgctaagtttagggattttattataaaatataaattaatcatttccattttggcggtcattacagctcttggagtgataattgttggctttattcatgctggaaatccattgactgatggctatcatagtttaggcgctgttatggctatccttggcggaaatgtgatgctgattcttgtttcaagagctatggctgaatttgaaagctatcagaaaatcacttttatattgggaattattggatttattgtcttttggataatgtttttcaatctagaaagcctttatatgcctgtctttgaaagattatctgtttataccttaataatctggaattttatgactggtttttatttgtataaaaatagttaa

SEQ ID NO: 1310 - DNA, 348 bp, Methanobrevibacter ruminantium
atgaaatgtccggtttgtggctgtgagaatccagatggctataaattttgtcatgattgtgggaatcctttgataatgcctgattatgatgaaatgaataatgattacccctcctttgatagcaaaaagcttatcataataggttatataatcgctatcctattcggttggggaacttttatattaagtgccatatttggatcctatggatttatcggtttcatcgggctctttttcccaggattcatgttaaatagcaaggattccaatatccgaaagcacgcctatatccaattggcaattatgattgtaggtatacttgcgacctttttagtcttatttagataa

SEQ ID NO: 1311 - DNA, 726 bp, Methanobrevibacter ruminantium
atgatatgtcctgagtgtggtgcggaaaatcaagactctgcaaagttttgcaagcaatgtggaacttctttaaatcctgttgccacaatgaaaaaaactaattctgatgaatcaagacctatcaagtcaggtatatttaatgaaaataattcttcaccttcctcctttgaagccaaaggatcaggtggagacaataaaaatctaattataatttgcttaactgtaattatttgtgctgttttgatagcaggaggcttaatattcctatcaaatggttcaaataatggaaatgactctagtgatgttggaaattccataagtcttccagacaattctgttaatcaaacagatgatagtcaaaatcaaactgacaccgaacctgctcctaaaaagtctagcgtttcagatatgaagatactgagcggaagcttcacaaccggaagctctctaagcgataagacttggtgttccgtttatgttggagaaaagtatgctggcgaggatgttaaaataagcgttttatacagccgtgatggctctgacttgaatcaaggaaagattgtgccaaaaaatgttggttcagatggtactgtaagcgttccaagtgcagatgcatttaagtattatccagatcatgctttagtaaccatttatgatagcaatggtaatgttttagacactcaagaggttatcatgagtgctaaaagtggtactcagacattttaa

SEQ ID NO: 1312 - DNA, 180 bp, Methanobrevibacter ruminantium
atgaattatcaagaagaattaagtgatttttggaaacaatgtaaaagagttttaaaagtagctaaaaaaccagaccgtgaagaattttttgatttttctaaagttacagctattggtatagctattattggtgtaattggttttgtaattgttctattcggccaattattaggattataa

SEQ ID NO: 1313 - DNA, 882 bp, Methanobrevibacter ruminantium
ttgggaaaacgaggatatatgggtaatctatatgaaacagtccgaggagggactcctagagctgttgggatagttccttttattcttatcagtctctttatgccaagcggatttaataatcttgttttggtgatgggtctatgtgccttaatagatgatataatcggcagaaaaacaattgctaatttgccgattgagattggtcagcttgcaagaggaataggcatgctttgtgtaataggattaggatatcctattatgggagtctcatctattttggttgtccttttaatccagccaatgaatattgcagatatgcaaccgggaactgctgcagctacaaccattataatgagtttcttcactcttttagctgttgtgattatgcaagtaggtcctgtcttagagatacatccatattactatccattgcttgttttagttacatgtctagcttattgtcctttggatttcgctggaaagatcatgatgggtgaggtaggtaaccatacctttgcaatatctttaggaatctgtttttatgctctaggcggatttataggaactttaatattattcattgtaaccactggattgattgcatatttaagaagatataatctctctagattccttataaataaattgcatattccaaatcctacttttggagatttatttatggatgtcttaactggaggaggtttaggtgacttatttagaaagattctcttgaaatcaaaccagtatgatgttgataatgagatattgattgcccttggatttagacggttattgtataatccttattctcctaaccttgaaaaagtggttcaaaaagatagtagaacaaaacgtgcagatttaagaaggttttattag

SEQ ID NO: 1314 - DNA, 1024 bp, Methanobrevibacter ruminantium
atgataaagcaaacattaggcttaaatgtagaagataaaaaatactacctgaagctaattatagaggctgtattaatcggtttattctcaggattcattgtatccctgtatcgacttggattagaccactcagaaagcatattatcctacatcctaaagtatatccaaggagacttgaccctaatagttctatggtttgtcatacttgcaatcatgggacttatcaccgcccttctgatgaagtgggacccagacagcctaggaagcggaattcctcaggtcatgggagaggtgaaaggatactttgatgtgacatggtggaaaactctaatagcaaagttcattggaggaacccttacagcccttggaggactttcccttggaagggaagggccatctgtccaattaggagccatggctgcaaaaggagtatcaaaatacctcccaaacagcaagactgatgaaaagcgtcttttagtatgcggaagcggagcagggcttgctgcaacattcagcgcacctcttgcaggattcatattcacattagaggaaatcaacaagggatttgacagatcaatcgtccttgtaggtcttgtttcagcagttgtagcggttttagtatccaatgtattcttcgggcaaagcccaatctttccatttacatccttaaatcttccattggaatatttctggctattaatcgtcctaggaatagcaattggaatattaggatacatctacaatgtaggaatgatcaaggcagctgaaatgtgggataaattaagtttcctccctcttgagataaaattcatcatagttttccttgtaactggaattgtaggactcttcttgcctgaagtgcttggaggaggatactctatgatgcaccttatagagctaagcttgcctccattatctgtcctaattgtccttttgattggaaaataccttcttttaatattctgtttcggctcaagcgcccctggaggaatattctaccctgttcttgtaatcggagcatata

SEQ ID NO: 1315 - DNA, 699 bp, Methanobrevibacter ruminantium
atgaaagaagccttaatgataaattggggatatgtagtgcttctttttattttaggagcaataagctataaaagaaaaagcctagacatgctaggtgccctaataatgatttttatgggaataaccatcatcttctcagcaggagtgtcatggtttatcttaatcgtactgttcttcatattaagcataatggccacacgcttttcaaagccatacaaaaaggaaataggacaatacgaaaagaccagaactgcaaagaatgttatctctaacggattggtggccttcctgatggctgcattcggaagctattatctgccattggctggaggatttatcggagcagtagctacagctacagcagacacattagccagtgaaataggtgtccttcaagagcctcgtttgattacaagctttaagaaagtacctgcaggcacagatggggcaatatcaattttaggaacatcagcagcgattgtaggagcaggaattattggaatcgcttcatttttacttggaatcatgccagatccattgatagcaattaagatttctgtaatctctggaaccgtaggctgctttatagacagtatccttggagcagtcctagagagaagaaactttattaacaatgagcatgttaacttgcttgctaccatctctggagcaataataggtattatttctgtaatgtaa

SEQ ID NO: 1316 - DNA, 1024 bp, Methanobrevibacter ruminantium
atgaagcatagattaaatttagataataaagacccaaattatattttgttgaaagaaatatttaaaattatggattctagaaaatccaaaagtatattagcatcctatggatttaaaaacttaaatagaacaatatttacttttaaaattatatttataagtatgttctttggaattgacattccattcattttaaacgagcttaaatccaaaaaagaacttcgcaaatactttaatatttctgaagttttgactgcagatcaagtttataaaattttttcagaaataaactctgaaaaacttataaaatgtttaaacagaatcttaaactcaaggaatatggttaaaagaagaggaaaaaagacttttattgttgatgcgaccccagtggacgtagatattaatttccacagaaataaaaagactaaagaacatctggaaaaaattaatctcaaatggagttattcatcctctaaaggttattatattggatttaaagcaactgttgtattagattatgattctatgaatcctgtttgtattttagtccactctggagctccaaacgatgcaaaacttttcgaagaaattttagaaaaccttcaaaaaagacgaataatcagaaaaggagacacattaatctttgataaaggatattacagctataaaaactaccaaatcggaatcagcaaatacaaaatcattcctttcatttttccaaaagaaaaattcagcagaacccgattggatgacattttaacttatttactagccgtatttaacaaaacaaagagaataatgaaagaaaaaagattatacaatagtttaaaaatggaattaatgaaaaaaatagattcatgggaaaaatttaaaccaataaggggcaaaatagaagattttttcaaattattaaaacaaggcttgaatatgagagaaatccacaaatatactccaaaatcagtagaaaaaaccgtttatctaaatgtatttttgggagcactgattatatcacaaggattttact

SEQ ID NO: 1317 - DNA, 690 bp, Methanobrevibacter ruminantium
atgttgtggacagattttattgttttggcgattgtttatatttatgtggttgcaatttttatactgtctgagaaggtcttaaagagcaggccagaggtctcccgtaagtttttacatattatggtaggtaatatgatatttgccatgccattcttctcagatccttggattatgcttttattcattaccttgcctgtaactgtggcactattcttccttacagagtactcccctattcagattgaaaacagcgttaccgaatccggacatgcattaggactcctcttttatgcattgatttggtccatattgctctttgtctacccaatcatgcttgatcctaactatctttggattgtagcaatggcaatcgttccattggtatatggtgacggatttgctgctcttgttggaggaaaatggggtacaatcaaatatcatgtatttggaggagagaaaactgttgtaggttcccttgcaatgctttctgtaactgcagttctttctgtatttgtttgggtgttctacagttcaataggatacactcttccagagcttaatttatggtatatattgcttatatcagcagttgcaacattgtgtgaagctctcagttatggtggtgtggacaaccttactgttcctgctgtaacttccgttttgtattatattgttgcgaccgtcctctaa

SEQ ID NO: 1318 - DNA, 627 bp, Methanobrevibacter ruminantium
atgaatataaaagagttatttatagaatccctaaaagacaataagaaactaataataggactatatgcattttttataatagttttcattgcagcttggattataaccggtccgaaaatgcaggccattgcaagcaatgtaactgcaatgaatggtcctggaggagcccaaagcagcgcaattgaacttttcatccataacgaacttggaggaatcattacataccttgcatcagtattctttggaattgctgcaattgtattgctaggatacaatgcattaaatttaggaagcattggacaattattcaatcatttcatgccaaatggaggaatcttatacctaatttacctaattccccatggaatatttgaaattactgcaacagtccttcagtccgcagctggaatactattgttcctattcatttggaggttcataaaggcatttagaagcaaggatacaaatggggcctctgacgcatttgagatgactaaaaagacactgattcagagcatagtgctaatggttattgcaacaatcctcttacttattgccgctccaatcgaagcatatttctcaactgcattttcagaatttattatggggtttttaggacttagataa

SEQ ID NO: 1319 - DNA, 1024 bp, Methanobrevibacter ruminantium
atgaaatatctttttttactctttggaggattggatgacatttatttgcttttactcactattttattcggtatattgaatatggttcccatgttctttgaggaaaagaagtcaaggcctattacaaggcttcttgatacgatatcaggattttggatatggatgtctctcttttacttatttgtcatattgattatctatatcggaggagtctatattgattggccgttttatattatagtcattctagttcttcttgttccattattgacagtctattcctatttccatgcacataagatcattattcatgaaaggacaatccaaatggataatattaatgaggatatcaacattgcccacctttctgacgttcatttcggctcaacaaggcatgataagatcattagggatctttctgataaattgaaggagctttcagattattgtgacttggcaattatcagtggagacattgttgatgggtcctctgctattgaagaggatgattttctacctcttaaggatgtgaatatgcctatagtctttacaccaggcaatcatgactcatatctggatattgaggacgtctttggggcatgcagaaatgcaggcattattgttctagacgatgagggaatggaattcggcaatcttaatatatttggaatgacattcatctttggaatgacccgcaagtttgaagagtttgaagtagtcagcacaggtgtattaggggatttcgttaaggaagataaggtgaatattatcattttccatgttcctaaaaactgggaggacttttctaaattaggatttgacattcaattgtctggccatactcatggaggccagttccatccacttacttggatatgcgatcttatttggtataacagaggtctttttaaagctaatattggtggcaaggacaggtatttgcatgttactactggtgtaggctctatggattatccttttagatggggtactgattcagagatagttgttctaaaattaagaa

SEQ ID NO: 1320 - DNA, 849 bp, Methanobrevibacter ruminantium
atgatcttaaatcttattttaattatactaatcgccttaattatcatattttcaataatcctatacaatggtttaagaataattctaactgttgaaaaggaaaaagcagaagccagatacaaattaaagataactctgcttaaaatccctatttttacaaaagatagctctgaagacaaggctacagaatccgaagaggaaaaagaagaagatggagaggaagaagagtccaaagacaaaaaaggcctgatggaaaaatacaatgaaattaaacctatcctaaaagagctaattaaatcaaagaaagaattaaagaaatatctaaaggacattctaaaatcaattgatataaagaaactcgaaggacacttgatactaggcctaagcgactctttcaccacagtcaagatagcaagttggatatggtcaataggagctatagtaaatagtaaaaagccagtttcattaactgtagatcctagatttacagagataatcactgattttgaaggacaattggaattaaagataaatctactgaaaataatattttatagcttaattttagtaagcaaaaaggacattagagaattgattaaagtaatttatgcttataaaaaagccaaagataaagaaaatgaagaaaaagaaaactccaatgaagaattatataaaaaagaaaaagacactgaaattaaagaaaactccaaagaagaattatataaaaaagaaaaagacactgaaattaaagaaaactccaaagaagaattagataaaaaagaaaaagacactgaaattaaagaaaactccaaagaagaattagataaaaaagaagaaaaagaaacttaa

SEQ ID NO: 1321 - DNA, 1024 bp, Methanobrevibacter ruminantium
atggatgatgaaactaataacaatcaatggaacagttcaacaagcttcatacttgtcatggtaggatccatcatagcattggcagggatttggagattttcctatcttatttatgaaaacggagggggcagcttcctaatcccatacatattagccatcgttatcatggtcatcccccttcttgtccttgagtttggagtgggattcaaatacaaggcaagcctgccaaggatattttacaatatcaagtctgaatttgaaatagtggcatggtttatccttttcctaatattcatagtcctaatctgctatacttgcataatgtcctgggaccttatctacatagtcctaagtttatttaaaggatggggcaataatcctagtgttttctttacaaccaccctacttcatagcacctctaatccatatggcttaacttaccttgtagttcctattggaatcggcctcatattaatctgggccttgatatatttcatatctcgaagggaaataaataggggaatatcattagtgacaaaattttccctggcattgacatttgttctcgtcatcatcctttcagtctttgcccttcaattgccaggatccagaactggccttatggccttgttcaatccaaattgggaatatctcttggactataacatttggctcactgcattcggacagcttatattttcctatggccttgcatatggaatcgcaagcacatattcctcctatcttccagaggacagcaagcttatagacagcgcatgggttattgttctaatcagcctaatattcgaaattctgatgtctgttctcatatttgcattgcttggacatatggcattgggaaagaacatgcctattacaagccttgtaagcgacagcttctcattgatatttgtggttttccctaatgtattcaatgtgatgggctcatgggcaacaataataggtccattgttctttatggttatatttatagggggattaggtgcattatttgctcttatag

SEQ ID NO: 1322 - DNA, 1024 bp, Methanobrevibacter ruminantium
atggcaaacagtaatcagtctgaatgggatagtaacattgcatttattttggcaatgattggttctgcagttggtttaggaaatatttggcgttttccaaatgttctatactcccacggtggaggatcattcatgattccttatatcgtatccctattccttttaggaatatcatttgtacttgtggaatatgctgtaggatacagattcaagtcctccctaatcaaggttctatattctgtcaaaagcaaattggagcctgtagcctggtttatcgccctaatcgtctttctcataacaacatattacatatgtgtagtgggatgggacttgatatatgtggtcttaagctttacaaaggcatggggctcaaatccagaccttttcttctcaagcattgtccttcaatcaacagattccattgaagggcttctccatattgttcctatggtatttatatccgtacttgcattatgggctgttgcatggtacattattcaaaaggacttaaatgacggcataggtaaggtaagtaagttactgcttcctttgcttttgattattgttgttacaatcgttttgttctcactgaccttgcctggagcttcaataggctatacccaaatttttactcctgattggagtgccctaactgacttgaatgtttggcttgctgcctttggacagatcgtattctcccttagcttaggaatgtccattgcacttacatatgcaagctaccttcctgaaggctctaaattaacagacaatgctttaatcgttgcattttcaaattctggatttgaaatcttcaattcaatcggaatattctcaatacttggttttatgaccttaaacacaggcattccatttgaccaactggttactgaaggaacaggcttggcatttgttgttttccctaaggtattcaatataatgggtccttgggctacaatcatcggtccgctcttcttcctatgcattctctttgctggtgtaacctctgtaatggcattgcttgagg

SEQ ID NO: 1323 - DNA, 1024 bp, Methanobrevibacter ruminantium
atgaatttagacagtaacgttaaaaccggattgattgtagctatttctataattttcctttttgttttatcattgtttattactagtgcaccaacaggagtggataattctgctcgtttcggaattttgacactgcttcctcctcttatagcgattgctttagcatttattactaaagaaactattctatcactattcgttggagttttcgttggtgaattcatggtttcagtaagtgatttaaacatcatcagctctgcagttaatgcatttttagctatgggtggtcaaatcatctcatgtatggctgatccatggaacgctggtattgtcctccaatgtctgctcattggtggtgtaatccaattaattacaaaaatgggaggagcaaaagcgttagctgatgctttggctaaacgtgctgacactcctagaaaagctcaacttattactgaatttttaggattatgtgtattctttgatgactatgctaactccttgattgtaggtcctatcatgagacctgttatggacaagcttaaggtttcaagggaaaaattagcatttgtagtagacgcaactgcagctccagttgcaggtattgctattatttccacttggatcggtcttgaaatcagtttgattactcaaggtttcgaatcaatcggcatgaatgtaagcggattcggaatattccttcagaccattccattcaggttctataacattttaatcttgattttcattgttatctctgcagttaccctgtatgagttcggtccaatgaaagaggcagagaaaagggctcgtgcaagaaaagctgatgaacctgttaaatctcttgaagcaaccagctttgatgatgtaaaacctgtcgaaggcattaaattatccgtatggaatgctatcattcctattgcagtcttaattatcggcgctcttatagcattctactggagtggttacactaccatcttaggcggtgaagaccaagcgctcattcatttaatgaaaacttctccat

SEQ ID NO: 1324 - DNA, 1024 bp, Methanobrevibacter ruminantium; identical to SEQ ID NO: 1001

SEQ ID NO: 1325 - DNA, 1024 bp, Methanobrevibacter ruminantium
gtgataattattggaggattaaaaaatatgaatgaaaccattaaggaaaattcttgggttccactaatagtcgtggctcttgcttcctttattgtagctttagacgctacattcatgaatgtgagtatttcacaggttgttgttgacttgaatactgacgtcagtacaattcaatcaatcatgtcattttatactctcatcactgcagcatttatgctcttaagtgcaaagcttcaagacatagtggataaaaagaaactgtttttaataggtactgctctttatggtgtaggtacattcaccgcatcaataagttcaagtgctggaatgttatttgttggatgggcagcaattgaaggtgttgctggtgcattaatgatgcctgcaaccgtttccatcataagtggaacatattctggtgaaaaacgtacagttgctttggcgattgtaggtgttatgggtgcagttgcagccgctgtaggcccactcttcggtggggtcatgacaacatttttaagttggagatatggatttgcagttgaattgataatcgttttcgttattttaatattcagaaatagcatacctcatttcgaacctactgaatctagaagcgatttagacatttcaggcgctataatttcatttatcggccttgttttattagtactaggtatcttgtcactatctaaagatttcacaacaagcataggcataattgtagtaggattaattgcattagttgcctttgcatactttgaaatcagaagaaaaagaaatggcaaagtaccattacttgatatggaactatttaaagacagaaatttacgtgtaggaactataattttgttattatcttaccttgcaatgggtgggggattatttgcagtttccctattcttgcaaagcgtattgcagttaaatgcattcaatactggtgtgactactcttccattaactttaggtttgcttatttttgcagtattggctccaagtttaacagaaaaattaagtcacaagaaaa

SEQ ID NO: 1326 - DNA, 462 bp, Methanobrevibacter ruminantium
atggaacctaataaagtatctggaatattatccataattttaggattaattttcataattttccctttggttagttccggattagtatccatcatgattggagttagcttactattcttaggtatagcatcaattctaaccgaattttcagcactcaatataattattggaattcttgcaatcatattcggtttgctattcatattcaacattgatgcattgtccttccttttaggattccaattctacattattggtatcttaatgatcttaataggtgtagcaggtatctttgcaggagaaggcgtatcaaagattgcttcaatattgattataatcttaggtgttattgcattaggccttggaggcttttcacttacccaaccgattttcgctgcagtacttataggcgtagctttaatcacccaaggtgtaaggttatatgtagcaccaaaaaattaa

SEQ ID NO: 1327 - DNA, 840 bp, Methanobrevibacter ruminantium
atgggtgttaatatggaaataatggaaataattaaagattcttttctatttccatctaaaaacttaggaaccttctcaatttatgttgtattgtcagtattagttgcaacatttacttttggaggaatattctcctatttattagggtttattggctctgagtacattttaataggcggattaactcttgtatttgcaatgttaattggatgggtaatgtctggttatgaaatcagcattattaaatctggtattgaccttgatgatgaagttcctgagtttaaatggtgggataattttattacaggttttttaaactttattgttgcaatcgtttactttataattcctgcttttattgtgggagttgtaggatatcttataaatattaatgacaaacttatggcagttgctcaagagatttcttcactctatccaaatattttcttgacaagttctccggatattgcatttgaggcattgtctcaagcaataattgaattaatagttcctttagctattctcattattgttgctctaattgtatttgtaatctttttattcctccaatccatggctgaagcaagattggcaaatacgggtagtttaagtgaagctttaaacatttttgaagcagctaaagatataaaacgaattggtgtacgtaaagtaattatagtaatcttattagtttttgtaattattggtgttattgggatggttacatctgttatatttaactatgtgccaacattatcaattctttcaattataataagcccatacttagtattctttgctcaaagggctactggattattatattctgatatagcttaa

SEQ ID NO: 1328 - DNA, 1024 bp, Methanobrevibacter ruminantium
atggaaattattaagggaaaagaaattccgaaaaaaagtttaaaaagaagtttaatcgtatttattggaaatatgataggaatatatcttataagtattttaggtttaggagtcgaaattagccaaactggtgacatattccttttagtattattcctaggtatagtaaatgcaatactctggcctattttaacaagaatagctatgccatttttagtattgaccttcggaataggttcattaatattaaacggactccttcttcaattactcgcaccatcatttggaatagaaatcaaaggtgctgcaatgattcttgcacctttaggaatggcggccgttacaacagtgctatctagcttaataacaattaatgatgacagttcctattacagatccgttttaaatgatgccaaaaagaatgcaaaaaatgaagtcaaggattatccaggcgttataatcgttgaaattgacggacttgcatataatgttttatgtgaagcagttgaaaaaggagacatgccaactcttaaaaaaatgattgaaagcgaagactacaatcttagaatgtgggaaactgacttgtcttcccaaaccggtgcaagccaggcaggaatccttcatggaaataatgaaggcatcgttgcattcagatggatagaaaagagcaatggcaatcagatgatgcaatgctctggaatcagcaatgtgccggaattggaaaagagaatttcagatggtaatggattgcttgtagaaaatggagcaagcagatctaatttattctctggagatactgacaatgtaatatttacattcagtaagataatggactttggaaaactctataataaggcatggtactcagtattttccaatccaagcaattttgcacgtattgtctcattgttccttgcagatattgtacgtgaaatctggtcacaaatcacacattccatcaaaaacataaggccaagaatcaaccgtggaatagcttatattccaacaagagctgctacaaacg

SEQ ID NO: 1329 - DNA, 804 bp, Methanobrevibacter ruminantium
atggagatttttaaagttgtctgtgaattaataattccaattttaatatttggtgtgttatttgcagttggaaaatttattcatgtaagattattgaatagtaaaagcagaattttaaatccaggagaatatttccctgatgaggaacttgaaacattaaagcaagtttattatttggtaatgatgttaatattctttgcttttatattatacatcatgatagttcaagctaatgaggtattcgcgattgctgttttacaaattcttgtgtcagtctatgtcgctttaactttggattatagttatttgaaaaataagatattgttcttcctcttggttccttttgaagctataatattccttgttttcaatgattttctaatgatttggccaatttatttgatgcatattcttgtttatgcatatttcatcaaggtatacttcgataaatttaggaaatatactgaaacaaatgggcttggaataacaatcatactattattcgctatagtttttataagcttcattatcacactatttgtggaaggtgttgaacctttaaattctgctgtaatggtttcaaatgcatttacaagtaatggttatgcaatacttggtaactcaggcattggtaaattgaccagtttggttttagtttggagcggatacatcatatctggtgtaggtactgcaacattaaccgctgcaattatgatgagacataatcaaaaacgtgaaaaagagttaaacaaacgtttagatgagttggaatcattaattaaaaatagtaataataaagaataa

SEQ ID NO: 1330 - DNA, 828 bp, Methanobrevibacter ruminantium
atggatttgcttttttatgttgttttgctgttgattggaggttgctttgcaggtttcatggcaggccttttggggattggcggtggaattgtaatcactccaatccaatattatcttttaacctcaattggatgtgatcctaaaacgtccctaacggttacctttgcaacaggtcttgcagttatctgtgtcacgatgataaacagtacacgaaagcacaaacaaaacaatctaatagtaaaacagcacctaaaaccaatgatggtctttggttttgtaggtgccattctgggtgcagtcatatctcaatacatagatgttgaggttttaaagattttgtttggtgtaatatgtatagtatcaacagtatttttagttttaataaaatctcctacctctttagataatattaaaactgatgcaggattattttactctattgcatttgcatgtggtcttgcaagcggattgataggtcccgcaggaggagcatttatcataccgattttcgtggcatatttgagatatccaataacaaatactatcggaacaacttcagcattaagcatcgcaaccacacttgcaggggtaatctgttatattgttttaggttggggtgttcaaggattgccggatttttcattaggttatgtcaacttgcttcaattcgtatttttaacaataactagcattattgtatccggatatgctgctaacctatctaaaaaaatcaatcctacaaaattaaaagcgctgcaggtaatcgtaatatcatatattggccttcaaatgatgggtgtattcgacataatattaagcataatataa

SEQ ID NO: 1331 - DNA, 333 bp, Methanobrevibacter ruminantium
atgaataatattgcttatcttttacttgcaattctatttgaaaccagtgccacatcactgttaaaagttgctgaaggtttcactaaaccattgccaacaatagcatcaatcatattatacatattatcattttacagtctcagcaactgcctaaaaacagcaccaataggagttgcatatgccatttggtcagcattgggaatcgtgcttgtgacaattgtagggattatcgctttcaaacagacccctgattgggctgctatccttggacttttacttatcattataggtgtaggggtgctaaatctattctcaaaaatgagcttacattaa

SEQ ID NO: 1332 - DNA, 1024 bp, Methanobrevibacter ruminantium
atgaaaaagtttttgagtgttgcattaaaattccaatggaaaacaatagtgtttattttcgcattaataatcattcagacattcgttcaaatggaaataattgatttgttcggtgcggctttgactggagtcaaagaacagaacgttgatttgcttttcaaatcaggattatatatgttaatgtataccgtcatttcaatgattgccgtttatgtcatctcttttctcacaacaagagtggcttcaaaatcagcatatactgtccgtgagaaaatattccatattctgatgaacttgcctcgtgaggaaattgataaatttaaaatttcagggctagttacaaggtcaaccagaggtatgtcctccgaacagggatttatagtgatgatactcgaacagttaatgcttattccagttacattcgtagcaattgtatatgaaatagcattgattgatggaacttatgcattatttttcttaggatttattggtgttctttctgcaatcataatttttagaatgaaacagattgtggaaatatttttcagagctaaaaagacatatggtaaactaaatttattattcttatccaaaatcaatgatatagctggcaggattccatttaacaaacaggagtatgaagtcgaatttgaaaaggcatgtgagaactcctatgataaaaatgtcatctatattaaaagtcaatgttacctcggaccaatattaatgtggggtttatatgttattgtcctggttacattggcaatggttaattcaggatacaccattggatttgaaactgatagtgtaattgattcattcattattctggtatatgttgcctacttcatcactactctagctaatattcctgcattaattgacagatggccacgtgcatatgccacttctgtgcgtttggaggaagtcttgaatattgaagataaaatcataaaatccaatacaaatgataatctgaaggaaatagagattgttgaggaggatattgctcaagaggctaagg

SEQ ID NO: 1333 - DNA, 828 bp, Methanobrevibacter ruminantium; identical to SEQ ID NO: 1330

SEQ ID NO: 1334 - DNA, 333 bp, Methanobrevibacter ruminantium
atgaatttatataaggatatattctatctggcaggctttatttgccatcagaagccagagagatcatttcacatatcccactgccaattgccattctgtgcaagatgctgtggaatcatcatatctgtcatcgcttcatttatcctcgctcagtttgtagcctttccaatgaatgccctggcttttcttctctttgtcccaatgattgtagatgggcttgtgcagaagtataccgattatgaaagcacaaatttcagaagattcataacaggcttcttatttggattcgcttatgtctatgtattttacatgtttggattgaacgctttatga

SEQ ID NO: 1335 - DNA, 861 bp, Methanobrevibacter ruminantium
gtgaagatattgaaaacttggattgaaaaacttgatattattctatcaatactgattgtattggacatttcatttctaacagcttcatttttgttggatttgaacacaacctatatcaatttcatgcttttgttcgatacaacattatgttggatccttatagtctcattcatctttaagctgcttaattcggatgacagaaaggcatatatgagggaaaattatcttgattttttagcatcaatacctatggaccttgttttgctccctttcagttcattgcatatcagcttgataaacatagtgattctagtaaggttcctaaggctgttactgctatttaaggaatcctacaagtatgtcaagaagtttttcaaggcaacatcctttgataaagtcgtagcattattcatagttatcgtagtgggctcaacattcgcattggaatactttgatcctgcaatccctaacctatactacagcctatggttcgtatttcagacaataaccacagtaggcttcggtgatgtgattcctgaaagccctgtaggtcagctgattgcattgggccttttgatggttggggtactcatgttttcaatattcactgcaagctttgcatacctctttaacgaaaaggtattccgtgaggaaaatgaggatttccatgaaaagataaacacagtcagggaaaatcttgcagaaaacaaggaaagggtagaggaaatcaggcaaagcactttatccacaagcgaagagattgctgaagttaaggaaaagctaaacaaatccgaagaaaatattaaaaacctggaagagcgtatagattaccttatagatatgattgagaaaaaggaatag

SEQ ID NO: 1336 - DNA, 1024 bp, Methanobrevibacter ruminantium
atgtcctatcaagaaaataatgcatctgacaagtctcttcaagataaagatatgaaagcgaagcagcgccaagatagaattgttaagacaagcataataggtattgttgtaaatctaatacttgttgccttcaaggccacaatcggaattcttgtaaattccattgcaatcactttggatgcagtaaacaatctaactgatgccttatcctccataataactattattggagctaagcttgcaggcagggctccagataaggagcatccttacggatacggccgtattgaatattttgcatctgtaattattgcagctatcgttctttgggcgggaatcactgcattgatggaatcatggccaaagatctttaatcctgatgttacaagctatactacagtttcattagtcatcgttgcagtggcagttgctgtaaaattcatattggggcgctacgttaagaatgttggagaggaaatcaattcacaggcattggttgcatctggaagcgatgcgttctttgatgccatattgtcattttccactttgattgcagctttagtctccatattcttccatatttctctagaagggatcttgggagtgatcatttccattgtaatcattaaggcaagtatagatatgctaaaggaaactgttgacagcatgattggagaaagagtggattcaaagcttagtcgcgatataaaggaggcaatttgtgaatttcctcaagtctatggagcatatggcttgagcctgcataactatggtccagatagcatggagggttctgttcatattgaagtggatgacagcctaacagctttagagatacataatctaactcgcttgatttcaatgaaaatatttaatgagttttccataatattgacagtaggaatctatgctagaaatgacgattttaaggatattagaaatgacctttatgaaatcacctccaaatatgatgaggtcatagaaatacatggatttttagcctatcctgaagagaagctgataa

SEQ ID NO: 1337 - DNA, 915 bp, Methanobrevibacter ruminantium
atgaatagagaagaacgagatagaataggaacacgtgcatctgcagttgcaattattggaaacatcctccttactgtattgaacatctcagtgggactgatgtctggaagttacgctcttatatccgaaggggctcatacaatttccgatatagcaacatctgtaattgcatatgttggattcaagatagggagcaggcctgcagataaggagcatccattaggccacggaagagcagaagcaatctctggccttatcatagttgtattcttatcaatagttgccattgaagttattcaaggagctttccataagctcttctttggaggggctttggaagtgccagatcctatagcagtggtaatggcctttgtaggtattttggttaacctcttcatgagcagctatatcattcgcttggggaaaaaggctagaagccctgcgattgtagcagatggaaagcatcagagggttgatatatttgcatcattggcaatattcattggaataatggtttcccaatatggctatcctatgctagacccaataataggtattttcattggggcattgattgctaggactgcagttattgtagcaatagacaatctaaacaatattatgggtaaattgccttcagatgagttaatcaaggaaataagggatgttgccaattcagttactgatgtatgcagtgcccatgatattaaggtgaattattttggctcttatgcaaccgttgccctccatgtggagcttccgcctgatatgagcttgagggaggctcataaaatcacccatagggttcaggataagatactggaaaatgtggatatggttcaggcagtgcatgttcatccttgccctgaaggggtgcagtatgatcatagtcaattattggatgaggattcttaa

SEQ ID NO: 1338 - DNA, 204 bp, Methanobrevibacter ruminantium
atgaaagaaacactgattaaggagtttaaagatttaaaagaagaaactggacaagccagcgttgaattgattttattgattggttctattttagtaattacaattatttgtggaacttatgtatttaatgttaattctaagataaacggccagtttaatcaaacaatgactaaggccaggttatttcttttaaataaggtctga

SEQ ID NO: 1339 - DNA, 279 bp, Methanobrevibacter ruminantium
atgagcgctaatgaaatagaaatatttgaatctggaaatggaatgaatcgacttccaagggaaactgtctttgagcaaatcaaaaggaactttgtccaattgaaggatgaaacttccggccaaggagctgcagaatatattctcctattcggaggagttattgtaattgccttagcaggtcttttaatctatagatcctacttcagcaataacaccagcggattgaatgcgactcaggacatcaactccatcagagacaatatgagcaatgtcttatag

SEQ ID NO: 1340 - DNA, 1024 bp, Methanobrevibacter ruminantium
ttgtctgattcattagatttatttacaggagttttattgacagccattggtttagttcttatttatggaagtataatctaccgtctaatcgatctagttttaatattaggtgttttagtcaccctattcggtttatacaaattgcttccagcattctttatgagattgctaagttcaagaaaatcaagctcaaggaataagctttcaaaagccaatgtttctcaagattctcttttaaaggcaggaattgaagagataaacaatttccttgacggcgaagacaataaggaaaattcaaaatctgtcttaagagctccaagggaaagctctctagatgctcctaatcaaatgacctttgaagaatatatgagcaagtcaaaaacagattatgcaaccaattactcacctaaggaagtaaagcctatctttaaggatagagacgttgatgaatccaagcaggttcttagaacaaagcctgtcaaagaggaaaagtctaaattcaagcttccgtcatttaagagaaactcttccaaaaagccaaaatcaagaaatttcgctttcagaaaggataaggacacagagcgatctccagacaagctctactttactccaaattatgaaaatccaatgatggtaagccctaaacctaaaaagaaatctgaaaataaattaaggctatctgactctccaaagagatctaaagaaatctctgaggcattggcaagtgttggcactacagaaacagtctatgacaataatgcttcagatgacagctatagctatatgcctaaggaaatggatgatgaattaatcgtgcctattgatgagattgatttggatggccctcaagaggctcctatatacactctttcacagtctgagaacaccctttataataatgtaatttatgatgacgtcgattcagacttctatattactccaatccatgcagaaagcaatgaagacaactctcctgatgaagaaggggattatggtgaaggaggagacttatatttagaagtag

SEQ ID NO: 1341 - DNA, 273 bp, Methanobrevibacter ruminantium
atggatacaactgttaaaactgtatcaatccatcttgttgcagcagtagtggcagctattatctctactgcctttacattaggatggtttggttttaaaaataacgtatttgcgtttgttattggtgtagtgattctttatttcattggacaatattgtaaaaaggcatttggcgaagagataagtggattttctacatggctatgggatggaatccttccattcggatttttctggttcatattatggactatattgactaattatttataa

SEQ ID NO: 1342 - DNA, 1024 bp, Methanobrevibacter ruminantium
atgagcagtgttgcaggattatccaaatacattagaacattgcctaaagccaaaagcacttttctaatgataatcgtattgagctttatcataggcgcagttctctttttagtaaagcctatgagccttggaagcggtttggagaatttcttctacggtggtgcattcggatttgtagtttatgggcttcctgctattatcactggtgcaaccgatcagaaatgggttagcaccctaaaggggataaacctaaagatgaagcattccatgttccttgcccttgtatcaatgaccatggcaggggtaataagcatcataggaacaatcataggaaatatcctccacttcgacctgtttataaactcaattctttttggaatagtaattgcatttgcattcaatatccttgtaatatggagcgttacacggattaggctcatcaaatccgttcttgttgcaatcattcagccattgctcatgattggagtattgattatcacaagctttttaaacaacctagaaagcgtctttgagcttggaatatttacaaccttcttcaaggtaataatagcaagtgcagtcttcttgcttgcaatctattcattcatttcaattgtagaatccccaatgaaaaagaacttaggattcggagctttggaaatcctcagtttcttcatttcacatatgaacgaaggttccaagtcaattgaagagcttttcgacaatgctggagaagcaattgacacacttgttggggtctgcagcttcagaaagccagacggagatattaaggcattgttcattagcccttgcgttcacccaggacctcttggagacattggaggttcaaatatgcctacaatccttgcaaacagatttgattcatttgcaatggttgcacatggaccatccacccacgacttcaatcctgtatcaagcgatgagatcgttaaaatcgagtcatcagtgagaaccgcattggaaaatatggaatactcatcaaaggcaagcagattcgtcagat

SEQ ID NO: 1343 - DNA, 1005 bp, Methanobrevibacter ruminantium
ttgaaagcaggagttcttgtattcacaggaagtctggttgctatcgacccatctttctatccaatcatgctcttgcagcttgttattggagctattatgatcttatatttggatgaagtagtatccaaatggggattcggtagtggtgtaggtttattcattgctgctggtgtagcagaaacaattattgtaggtacatttaacttcttgccagcttccgctgcctcaacaactgcttcaggtattcttcctgcatttattcaatcaataattggtggagcacctaatttccaaatcttgattccattgattgctaccattgtagtgttcttgatagcagtatatggtgaaagtatgagaatcgagattcctatttcccacggcagagtaaaaggacacggtagaatcagaggggctgtaggtaaatatcctttgaaattcatctatgcaagtaacatgccggttattttaaccagtgcgcttcttgtaaacgtatcccttattgcaagtctcttccagaaattaggattccctatatttggagaagtttcaggtggaagggctatcagcggacttgctttatggcttaccacccctaacagcataagcgtattgtttaccaatcctttaagggttttattctacgcaattgtatttttaggctgttgtgtactcttctcatggctatgggttgaaatcagtggttccttaagtgctaaggaagttgcaaagcaactctataactctggtatacagattccaggttttagaagtagtaaaagacaactttatacaatcatgaaaaaatatattccagctcttacaatccttggtggtttattcgtaggtattttggcatttattgcagaccttaccggagctttaggcggaggtacaggtgtattgcttactgtaggtattgtatacaagctctacgaagagatcgctcaagaacaacttatggaaatgcatccaatgttaagaaaattcttaggaaacgattag

SEQ ID NO: 1344 - DNA, 609 bp, Methanobrevibacter ruminantium
atggcgtatcaaggtagttttcttttaggtatttcctggcttcagccagtattcgatgcaatgaatgctgtccttaatcctttagttcaattggatccaactccaaataatcctgtacttactgtatttgtgatatctgctttaatatcccttttgacagttactgcacagaaattattagtggaccaagacaagatgaatgagatgcaagcaaattcaaaggctttgcagaaagaattaagagaagctcaaaaaagtggagatgctaaacaaatagcaaaagttcaagcaaaacaaacggatatgatgcaagaccagagcgaagttatgaaaatgtcattcagaccaatgattgtaactatggttcctatcttattaatattcgattggatgtggcaatccgctatacgttcacttattgttgtattccctccagctgtttattattgtactttaactccaattttccactctctaggacaaatgctttacggcggtaacataactaccattccatttggtgtaggttggttatggtggtatttcatttgtacttttggaatgagtcaaatcattaggaaatttatgggattcaagaacggtttctag

SEQ ID NO: 1345 - DNA, 480 bp, Methanobrevibacter ruminantium
atggcattccttataataacatgtctatttctgatattcttcttcggaagcggaaaggtcatctaccaaacaggattctttggaatcgtagtcaccgacgactcatggcattacggtctctacacattcttcagagtgttagggtgttttcctatcctaggattcctagcccttacaacacctattgcaaagatcttccactgtttggaaacacttaaggttcctaaaatagtgattgagatagggcttttgatgtacaatacaatcttcatattcctaaatgagattgatgtgatgcagaaggcacagaagacaagattagggtataattcctattggaattcattgcagtgcttaggatcgcttgtaagcaatatatttttaagatcattggaaaaaagcgaaacattgcaaaacagtttagattcaagaggctacgacggagagcttccggtttatataccgccaaaggaggaataa

SEQ ID NO: 1346 - DNA, 288 bp, Methanobrevibacter ruminantium
atggaaagaacaacattaattattttagcagtcatttgtgctataatcttcatagcaccattagttatgtacagcggtcttggtgaagatgatggatacttcggcggagcagacgatgcagctggcgaagctattgaagaatctggttttaaaccatggttctcatcaatatgggaaccacctagtggtgaaatagaaagtttattattcgctcttcaagcagctataggtgcaatcattattggttacttcttcggctactggagaggacaaggtaaagaagaatag

SEQ ID NO: 1347 - DNA, 666 bp, Methanobrevibacter ruminantium
atgcacattatggaaggatatttacctttgacatggtgtatcatatggttcgtcgtatcattcatcgttgtcgcttacggtatctatcaaataaaacaaattgtagatgaaacacctgactccaaggcattactcgctgtcagtggagcattcatgttcatcttatcatctttaaaactcccttccgttactggaagctgttctcacccttgtggtaacggattaggtgcagcattattcggccctgctgtaactgctgtacttgcaactatcgtactcttgttccaagcaatcttacttgctcacggcggattaaccactttaggtgcaaacattttctcaatgggtattataggcccattcgttgcttggctcgtatacaaagcttgcatcaaagctaatatttcatcaaccattgcaattttctttgcagcattcttaggtgacttattaacttatgtggctacttcattccaattagctttcgcattccctgctccttcttttggcagcgcattaacaaaattcttagttatctttgcagtaactcaagtaccattagctattggtgaaggtatcttaaccgtaatcatatgggacagattaaaagcttacaaaccaaaattattagacaaattaggtgtattagctcctaatgaagcataa

SEQ ID NO: 1348 - DNA, 339 bp, Methanobrevibacter ruminantium
atgagcgtatttgattatatttgccatagaagacctgaaagaagcttcttttataagggacggcaatttccagtatgtgcaagatgtacaggattttatataagtggaatagctagcataatcctatttaaatactttccattacctaacactctaacaacattagctattggaatcttgcttcttattccatgtgcaattgatggaacaagccaattgtttgagatgagagaaagcaataatgttctacgtttgattacaggccttttaggaggagtagggcttattatgatatatgaagtggttttaaactttgtctttttaaattttatttattaa

SEQ ID NO: 1349 - DNA, 354 bp, Methanobrevibacter ruminantium
atgtcaaagttttgtccgaaatgcggttgtgaaaatctagatgaagcttctttctgcttggaatgtggcgcttctcttcctagcattgaagaggttaaggaaaggtcttctcatggagctggaactagccatcaaagcacttttagttcaaatttaaatgaggaaaatggctttaatcaggaaaccagtagtttttcacagtccaactcaaattctaatgaagcaagcaattcaagcaagtttaaaaatgtaataaatgaggcaaatcccgccaataatgacaatcaagactatgctatctgttgcctggtcatatttgttcttttattgattgcattcctatgtaatttttaa

SEQ ID NO: 1350 - DNA, 660 bp, Methanobrevibacter ruminantium
ttgattccttattatatcctgccaagtcctttaaatgtatttaatgcggcatggactttaataactaatggaaaactcttcatgcatacctctagcacacttataaaggtattctcaggtatcattttagcatctgtagttgccattccacttggaataatccttggatggtatgagaccttagacagattaagctccttaatcataagtatcctaaggcctattcctcctatctcatggattccattctccattctttggtttggtataggattatcctctgcagtattcgttatctttatcggttgtgttttctcagtacttgtatacacaattgacggtgttaaaagaaccgataatgtattaatcgaagcagctcagactttaggtgcaaacaattgggatatcttgcttaagattgtccttccatccactttgccttatatagtctctggacttaaggtaggtgtgagcatagctttaatgtgtaccgtatctgctgagatgattgcttcaagcagaggtttaggttatatgattctaactgcaagtcaattgttccagcctggaactgtggtagttggtatgatagttattggtataatcggtattttatttgattatggatttagaaaagcgcaagagagaatattctggtaa

SEQ ID NO: 1351 - DNA, 1024 bp, Methanobrevibacter ruminantium; identical to SEQ ID NO: 1002

SEQ ID NO: 1352 - DNA, 465 bp, Methanobrevibacter ruminantium
atggattcaaaaggattaatcaacatagaacttttattttgcacaatcatcatagtcatgattctgatagtgaactttcctatcctagagcatagcatagattctgcaaatgatatggatgaaaactcccaaggccgatttttacttaattcgatatcaactagcatagatcaagtaaatagcaataatgaaggattttcaaagaaaataaaacttccccaatctgttgacggaaactattatacaatacttgtaagcagcaatgaaataatattggaattcaacaacaagaagggaaaagctaaaatccagcccataaatctagttgattcaaagaaccgaacattaagcaaggcgcaattatacaatggaggaagctacataattaaaaagaccctaacaaacaataatgagagccacatctataatcaaagttctataataatcatgcaagtagaaggataa

SEQ ID NO: 1353 - DNA, 1024 bp, Methanobrevibacter ruminantium
atgaacaaatatattaaaaaatggacagaatcaagtctgattttaaagatcatcggtggtttgattatcggatccgtattaggaatccttgtacctcaatataagttaattggacttccaggagagctatttgtaactgctttaaaggctattgctcctattcttgtatttattttagtggcttcagctctatctagggcaagcgaaggaataggcagtcgttttaaaacagtaattgttttatatttattttcaactttcctatctgctatggtagctgtaactggaagctatctcttcccagttggcatgcatttgacagacgctagtgatgtggcagcacctggcggattgggggaagtcataagttccatgcttcttaagatctttgcaaatcctttgcaatccttatctcaaggggattatttgggaattctcttttgggctattgtaataggactatgcttaaagaaaattgctagcgacagcacattggatgttttctccgacttggcagatgcaaccagcttggctgttaggggaattattcaatttgcccctataggtattatggggcttgtatttagtgctgtatccgaaagtggattaagcattttcatccaatacggtcaattggtcttattgcttgttggatgtattgcaacggttgcatttgtaacagaccctatcattgcagcatttgccttaaggcgcaatccttatcctcttgttttgacttgtcttaaggaaagcggaataactgcattctttacaagaagctcagcagcaaacattcctgtaaatatgaggctttgtgaaagattaggccttgacaaggacttctattcaataagtattcctctaggttccacaatcaatatggaaggtgctgctgttacaatcacagttatgaccttggcagtatgccatactttaggaatcagcgttgacttgcctacaacaattgttctatgtatcatttccactttggcggcttgcggttcctctggtgtagcaggaggtt

SEQ ID NO: 1354 - DNA, 1024 bp, Methanobrevibacter ruminantium
atgataaagaaggtgacaaatgtgattgatgaaataaccgatttcctatttggcttaaagatgactattatttcagggatatttctcttgattgctgttatttttatgatttttggaatagacactccgatttatctaaatcctgcatggggtacagtaataattagcggaattccaatgcttcttcttgccatgacaagattgattcgcgaaaaatgggtttcctctgctcttcttattgcaatagccatggtggcatcactattgattggcgaaatctttgcagcaggtgaagttgcatggattatggcattaggtgctcttctagaggattggactgtagagcgagctaagaaaggattgagaaatcttatcaatttaactccacagactggaagaagaatcgttggagatagcgaagaagtgatttctgttgatgagataaggattggcgatgtcttaagaatccttcctggtgaaagcgttcccgttgatggtgaaatcataaagggcagttcctctcttgatcaatctatcatgactggggaatcattacctattgataaggaagttggcgatgaagtattttgcggtaccatgaatatgtatggtgccattgacattaaggcaacaagcttaggtgaaaactcctctcttcaaaaattgattgaccttgtaaaggcagctgatgaaaagcaggctccgactcaaaggattgcagacaaatgggccacttggcttgttccagttgcattggccattgcaatcgtagcttggctagttacaggtaatattgaaaggggagtgactgttcttgtagtcttctgtccatgtgcattgatacttgccacacccactgcgattatggcagccattggccaagcgacaaaatatggagtcttaatcaagtctggtgaggcgcttgaaacattaggtgcattgaacactcttgtatttgataagactggtacattaacttatggtaatttagcagtttcagatattatctccttaaaggatgatt

SEQ ID NO: 1355 - DNA, 861 bp, Methanobrevibacter ruminantium
atggatgagtcagctaataagatgaataagtttgacgttttaggaagcatgaacttaagaaccaagaccctgcttgcaataggactctctgccttcatattgattgtagtggttcttgtcagtttcttcattgaccctacaagcatcacaaccgattggtccattatgaatcagccaccttcccttgagcacctattcggtactgactggatgggaagagatatgttcacacgtacaatcaagggtttaggattaagtgttcagataggattcttcgcttccatattaagtagcatcattgctgttgctttagctttcctttcaagcttcaacaaatatttagacagctttgtatcttggcttatagatgtgttcctctctattccgcatattttgcttatcattcttatttccatcgctctcggtggaggagcattcggtgtattggttggtgtggcattcactcactggacatctcttgctagggtccttagggctgaaatcaaacgtatcaagacttcagagtttgtaacaatctctgaaagattaggaaaatccaagttctggattgcaagaaagcaaatcttgccattggtaatcagccaagttatcgttggtacaatattgattttccctcacgcaatcatgcacgaagctagtgtaacattcttaggtttcggtttatctccacacgaaccggctatcggtatcattctttccgaatccatgaaatatcttgcaactggtaattggtggttggctttattccctggtttagcattattgattcttgtattgctctttgatattgcaggagaaaacatcaagaagatgctagatccggcaagcgcaaatgattag

SEQ ID NO: 1356 - DNA, 234 bp, Methanobrevibacter ruminantium
ttgcagttcttatcattcagtgaactcttcggtggaaccgttcttgtcgaacaggtattcatgtatcctggaatcggtcaggcagccgtttcagcaggtttgagaagcgacgtacctctgctgttgggaatcgttatcttcagtgcgatattcgtttattgcggtaacctgattgcagatattctctataactttgtagatccaagaataagagaaggtgaggaaaatggatga

SEQ ID NO: 1357 - DNA, 624 bp, Methanobrevibacter ruminantium
atgtctcctattaatccggttaacgcttatatttccaatatggttgtaagccctgaaaagattgctaaactagaagcatattggggtgtaaatcagccgattactgaaaaactgatcaattggttaggaaatattatcactggtgattttggaacttccttaatatacagaactcctgtattgcaggtaattgctgaaaagttcacagcatcccttatcttgatgctaaccagttgggtgatttctggaatattgggctttgctttaggagttcttgcaggatttaaaagagacacttggattgatagggttgtaaaggtatactgttacgtattgcaatctgcacctaccttctggattgctttgcttgttgtaatggtattcagtatttatctgggatggttcccagtaagcgggggcgttccgattggggcgctgagtcaggatgtgtccttcttcgattggttgaagcacctgatattgccggcatttacgctgagcattttaggagttgcatcaattgcactctatactcgtgacaagcttattgaagtaatgacaacccgaatttacttcctccttttgccaaaggccaagaggggaatccggatggaccttgattaa

SEQ ID NO: 1358 - DNA, 1024 bp, Methanobrevibacter ruminantium
atgaaaaacataagacaaacactaagcacaataggaaaaatgctcagtcctctaaaaaagagcataccttccatatttctcatcttcatattcctgcttatagacgtttactgtaaccttaccctcccatcatacactgcagacattgtagatgtgggaatacagaatacagacttcaactacataataagcgttggaacaatgatgatgaccatggtattgataggagttctagcaacaatagcgctatcctatttttcaagcaaggtatcagcagcatatggaagggacttaagggaaataagctatgaaaagatacttaaattctccaacttcgaacttaacaagatatcaagatcatccctcataacacgtaatacaaacgatgtataccaaatacagatattcttaggcctgctttttacaaccatcctatttgcacctatattaggaataggaagcatcatcaaggcaatggaacttggaacagacctcctatggattattgtagtgacattcgcctcagttgcaatactcctcggaataatattcataagaacagttccctactttaaggtgatgcaggaacttattgacaagatcaaccagacatcaagggaaatactgatgggaatgccagtaatcaaggcattcataaggcaggattacgaagaggaaaggtttgaaaagacaaatgaggagttcaaggaagtaaatctccatgtattcaaaaccctcttcctaatgattcctgcaatgacaatgatattgaatgtgatgatagtccttatcctatactttggggcatatgatgcaatcaatggaaagatactgactggaaccatcatagcattcatccaatactccacacagattgtaatctcattcctgatgcttggaggatttacaatcatgattccaagaatcctggtatctggaagaagggttggagaagtcctgaatacagagatatcaattagtgacggaccaatagataagatagatgagaatcccacaatagaat

SEQ ID NO: 1359 - DNA, 1024 bp, Methanobrevibacter ruminantium
atggcaccaagaccaagaagattgcctccggaaaagccaacaaatgtaaaggaagccatcaaaaacatatttggactcctaatgggatacaagctaaagctaagcataacagtcatttgcggtatcctatcaactgtattctctgtaataagccctctcttgattggactagctacaactgcaatattcgatggaataaactctggaaacatgaatctggaatatataataaaccttctaatcacagttgtgattctatacatcataagtgcagtcttctcctatctccaaagctatttcctcttggagataacaacagacatcagctataacctaagaaaagagttgattgaaaaaatcacccacctatccatgggagagatggataaaaacacaagaggagacatcttatcaaggataacaaacgatgtagactcactacagacaggacttaatcagacattcaaccaattgctctctggagtgattacaatagttggagtcacaataatgatgctttccatcaatatctggctgacacttgcaacaattgtgcttataccaattgcatttttaatcataacatttgtcacaaagcattctcaagactattatacaaagcagctaacctataggggaagcctgaacggacagattgaagagtcatttacaggccatgaaatcattcgttcatacaatcaggaagagcagtccatggaaacatttagggaagacaatgaaaactggtatgagcaggaatggaaatccaagttctattcaagcctctccgcccctctgatgaacttcatctcaaacttccaatatgtgataattgcagttcttggagcggtattcgtgcttcagaatgcaatagctgttggagacatattggcctttatccaatactctaaaaacttcacaactcctattcagcagataacaagggttatgaacatggtccagactgcaatggcagcaagtgagagaatatttggatttttagagatagaaaacgaagagaacc

SEQ ID NO: 1360 - DNA, 1024 bp, Methanobrevibacter ruminantium
atgatattcgtaatcaatttggttcctttatcattaagtgtggtaacattcctctcattattcctatctggaggatttacaattctatttggagccgacttggctttcctggtattatcatttggtcagcatgaatttactcaccctttcggtcctattgccctattggctattgtaaccgcattagcgtcgcttaaggttatggaagggtcgggtgttgatatatcaaggcttaaaaatatcgtatatgtttttcttatagcaataaccgtattcggtggagcaatgcacagatcattcctattgctatggttcatcggtctgttcataggttatactatcatttccaaatcctttaggcaaaagtctatccttacaatcagaaggattttaatgtttttccttgcagctttagttgcattcggtttgcttgagcttgtttccaggattttaagcatggaagttttctctccattgttaaggatttcaagacttgctcagaactctttggcaagtctaaaattggtaattggaaatactcaattgataggtcacgatcctgcttcatcctattggtctgacagtactggatttgcagatggttatattagcttgccaatgcaattcattttgatgtttggcttgccattcccattgttctttggtcttttggtaaccaagaaggatacaatcgactatatgcttccaggtatcttcggttatgcatatgactttggatatttgacattcgttatattgcttttattagtcttatttacaatcataataggcctgcttgttcttcgcgaatacagacttaaaagagaaaagaacaataagaaatatttaggtaaggaagttcttttaattggttcccttactggatttattgctcaagcgatcattggtttgttcctctttaacaggacaataaacggtatggcgctgctcacattcctgttcttaggctctttggtcttggctcatgttgtgactattagacgtgatagcaatgaagttttaa

SEQ ID NO: 1361 - DNA, 1024 bp, Methanobrevibacter ruminantium
atggaagaaaagaaaatagaatctacagatgttgaagtgaatgaatctaaagacttaaacttagattccactgtagagaataatgaaattgacaagactgaagaacttgacgcttcctctgaaattgatgagaatgaagaacttggcacttcctctgaagtaagagaaaccatagtcattgacacagccagtgaagtggttgaagcggatgtggtaagcgaaaccatagacagttctgaatctgtcaaggatgaagaggaggatagcaatcctcttgatgtagaatatgttgaagaagatggaaaacgtaggataaagcctatgcttgattacgaatctctttcaaatacctctgaaattgaagttcctccacttctcatcgaccaggtcataggtcatgaggaatctgtggaaacaattaaaaaagcagcaaagcaaagaagaaatgttcttcttattggtgatccgggtgtaggtaagtcaatgctcgctaaaggaatggctgagttattgcctcctgaagtcttagaagacgtattggtttatccaaacggggaagacagtaattatccattgattaggacagtccctgcaggtcagggcaaaaagatagtcaaggcaaacaaggccaatgcaaaaagcggcgatgagaagaagatgatgatcaccatgtttgcaactgcagctatctttgttcttggaatcctataccaaagaatatttgaagctatcattgctgcattgcttgtaatatttatttccatgcaaatcaagcctaaggcaaataacatgtctcctaaattattggtaaacaacggagataaaagatttgcaccattcatggatgctactggtgctcatgccggcgcattgctcggtgatgtaaggcacgacccttaccaatctggaggtcttggaacccctgcacacgaacgtgttgaaagcggaatgattcacaaggctcataagggagttttatacattgacgaaataggtacaatgagcatgaaaactcaacaagagc

SEQ ID NO: 1362 - DNA, 267 bp, Methanobrevibacter ruminantium
atgagttcaggattaactataggattgctctccttaataatttttgggaatatagaaaacttgattcttgcttcacagggagtagtaaaagccgcaaatccacttaaacttgcaatattcagtttaatatgcgtaagttgttggctaattttaggaacagtatgtacacaacaattacaaaattatggaatttacattgaattcattggcggatttgcaatattcgtattaggacttcaatccatgattgaagcagcgagaggatag

SEQ ID NO: 1363 - DNA, 288 bp, Methanobrevibacter ruminantium
atgtcatttgcagaatcattaaaagaatataaaccatttttaggtttattgatttttggtaacattgaaaacttagttcttgctgcccaaggtgttattgaaggagcagatccttttcttgttgcaggagcaagtgtttgctttgtaattatttggcaatttataggagtctttggaaccaaatcagcaatgaaatactctagacacattgaattcattggcggatttgcaatattcgtattgggaattcaatccatgcttcctttaatataccaattgcttggataa

SEQ ID NO: 1364 - DNA, 420 bp, Methanobrevibacter ruminantium
atgtatttgactaagttttgtcctaaatgcggagaagaaaacgaagatgtggctcaattctgcagtaactacggtcatgacttcaaggatgtgaatcaaagaatgaaggaatcgaaaagagagaactcttcattccccttgtctggaacaaagatactgctgtgcattgtgcttcttattgttttaattattgcagcattcctcttcactggcggaaacgctgacaagcctcaaaacattaccatgattaaggagaatacttatggcttcacttttgtcaatagaggggttcttttctataattatcacttagatgaggttttaccaatctgccggatgatttcgagggctatgactttaaggcaagattctacgatgcaaatgacacattggttaaggagtatcatgataactatatga

SEQ ID NO: 1365 - DNA, 777 bp, Methanobrevibacter ruminantium
atgaaatccattgaagacaatgcaagcgaaaagaccaagcaaaagcttcaaaagaaacagaaaaagatcgatgacatatcagaagctgacatagacgaacagatagaaacactggaaaaggaaaacaagaagcttaagcgctaccaaagaatcttagatgccctgcaagagaaaatggagattgattccggaagggtcatgggcttaactgacggaatattctcaattgtaatgactcttctaatctttggaataacattgcctagcaccgaaatcctaactgatgccggactttcaagtttcattagttccatactgccaaatattggagtcacacttgtaagtttcatcttgcttgcctcattctggatttaccatcatgaatttattaaattaaaatgcttaaacttggtttacctatggcttagcatgttctatttagcgacagtctgcttcattccatttacaacaacccttattggaacatatcctgaattccgcttatcaaccaatatttttggaataaatatattgctagttattatattcttcctattgatgcttaattatgcatctaaaagaggattccttgatgaagaggtaattgagaaagataagaaatatgtccatcacacattatatataatcctaggattggcagtgattattaaccttcttgactttagtgtgaatgaaaacttcatttacttgttcttcctagtgcctattatctctacaataagggatgtacgtttcaaattaaaaaataccgagtaa

SEQ ID NO: 1366 - DNA, 1024 bp, Methanobrevibacter ruminantium
atgcaagaaaaaattgacttggtttcactgcctaaaaaatcattttggaaattgagcattcctataatagctttctgcatcttcgatgcaatctacggcatcgttgatatgctatgggtatcaaggataagtgtagaggcattttatgcaataggagtgtcaataccaatcacatctctcattttctcattcggtgattcaataggccagggaaccaattcaatgatgtctcgttttataggtacgggagactatgaaagcgcatacaatacattgatacatgggattctaatcgcaaatatcatatggctcatccttgtgctttgtcttatattcgcacaggggatactgttcaaagtggatgatgccgattcatacatattgatctttgattatatggtccctatgataatttttgcatatgtattcatcttaaacaatctgttttctgaaacctttcaggcagaagggaattcccatactccaactatcctgattatcggttcaaatatcctaaacatcatattggaccctatctttatttttgacttgaatttgggaattaagggagccgcttacgccagcgtcctatcctcccttataacattctcagtcctgatgtttttatacactcatggaaggaccaagattcctttaagccgaaagtacttcaagttccgcagctacatacttgttgaaatatttaaggttacctttccaaacttcctggatgatgcaatctggagctttacaatgtctttcattaatgtcatattgattgggacaatgggagagatcggaccgatattatactccgtgtcaaacaagataaggtcattgctcaatgcccctaccaaaggctatggaaggggattgatgagcgtaacagggcatttgtttggagcggagcaattcgataagctgaaggaaatgtataagtatgtgcttaagatagcagtctgcacatcactcgttataatgattgtcttcttcttcgttagaaactgggcatttggcctatttt

SEQ ID NO: 1367 - DNA, 1024 bp, Methanobrevibacter ruminantium
atgataaatagactaagaaaagactttggaagaataataaaactcataatcttccttatattggaagtaattcttttctttgcaatcacccaaacatttggcgggatcataatccccgacttaaagactgcatttgcaataatcatcgctttatcaatattaaacgccctactttggccaactatcacttacctatccctaagattcatagtcttgaccttaggatttggaacctttttaatagacggagtccttctttatataataagcttattcatacctggagtgtccattaacggaatagcattattttcaattcccctgcttatcggactaatatcctctatgctttcaataatcctaaacattgatgacgactatacctactatcgatacatcttggaaaaggagatgaaggtgatacataggaacatccccaaaaaggagggattcctattcctggaaatagatggattatcttatagaatcataaaagaagccctagacaacggagatatgcctaccctcaaatcatggattgacaaaggcagccacagattgatctcttgggaaaccgatctttcaagccagacaagctcatcccaagcaggaattctccatggaaacaataacaacatacctgcattccgatgggttgaaaaggatcatgaaaacagaatcatctcctcaaacggaaggacagattcgaaattgattgaaaaaagaatatccaatggaaaaggcttattgtcattaaatggagcaagcagaagcaatctgttctcaggagatgccaaggaccatcttttaacattcagcagattcagcgattcagaaagcatcaattcaaacagctggttttatctttattcaactccctatgtaattgcaagaatattggttctcttcatctttgacatgattatggaactgttatcaagagtcaggcatctgttcaagaacattcagcctcgcctcaaatggagaggattgaagtattttgtagcacgtgcaggaaccaatg

SEQ ID NO: 1368 - DNA, 285 bp, Methanobrevibacter ruminantium
atgagtcaagcaagaaatttagaaaaggatgtatccagtagtaaagcttattttaaaggtgaaaatgagttaagtattaacagtaatattaatgaaaccaagttcaatgaaatgactgatagcgattctaatttctttggaacgcggttcattctgaatctaagtcttatattaaagttaatattgaaaaaacaaatgaaggtgatatcgcaaatagaaataatctcaaacaatcaaaagacgtcaaaacagtttcaatacaaaatcatacaaaaaacattatag

SEQ ID NO: 1369 - DNA, 891 bp, Methanobrevibacter ruminantium
atgaaaaagatatatcttattttcccaatccttgctggaataatgtttggatctacaggaatattcgttagaacattgactgaaaacggaatagattctacaacattgcttttcttgcgtttttcaattgcaataatttatatgctaattgcaattgtcttaactgataaaagcctaataaaagtgtctaaggaagatattccactatttctaatatgtggattatgcatacttggattaaacctatgctataataattcaataaatacggtgccactgtcccttgctgcagttctcttaagcactgcccctgtatttgtagtgatatttgcatatttcatattcaatgagaagattagctccgctaaagtaatttccataattctagtgattatcggatgcatattgacaaccggactacttgaagagagcatgattccgattacaagcattggactgattagcggaatcggatctgcaatattttgggcaatctatacaatagcctctcgaaaatcaatcgataggggaaagcatacatttacaatattattctattcattgattataattacaatcgttacaataccgtttacaaactttggacaaatcgaaagctttgttttggcaaatccggccaataatataatctttttattattgcattcattgatttcatttgctctgccgtatattcttattacaatatccttaaaccatttggatgcaggaactgtggtgattctatcctctggagagcctgtagctgccctcgtctttggtgcaatagtttataatgagattccaagcccattgatgttttgtggaataattataacaattattgcattgataagcttgagtagaaaaatagagatgaaaagtgaataa

SEQ ID NO: 1370 - DNA, 357 bp, Methanobrevibacter ruminantium
atgcacttattatggttttatgtagctatcgtacttgccataagtgatgaaatccatagcagaatagtatggggctatgtcagagacttttacatagtttttggcggaatcataagcagttctctagattctgtaatggaaacttggattgtccatgaaggattagaagcattattccatatgatattcgtatcaatagtcttcttttcattaaaaataggatttttagcggctttaatccatttcctattagatgtaagtcattcaatcgtcataagacatatgccatggttacctcatagagcattgcactttgttattgaatgtttattctttatagccgtatttggattatag

SEQ ID NO: 1371 - DNA, 1024 bp, Methanobrevibacter ruminantium
atgaagcatagattaaatttagataataaagacccaaattatattttgttgaaagaaataattaaaattatggattctagaaaatccaaaagtatattagcatcctatggatttaaaaacttaaatagaacaatatttacttttaaaattatatttataagtatgttccttggaattgacatttcattcattttaaacgagcttaaatccaaaaaagaacttcgcaaatactttaatatttctgaagttttgactgcagatcaagtttataaaattttttcagaaataaactctgaaaaacttataaaatgtttaaacagaatcttaaacttaaggaatatggttaaaagaagaggaaaaaagacttttattgttgatgcgaccccagtggacgtagatattaatttccacagaaataaaaagactaaagaacatctggaaaaaattaatctcaaatggagttattcatcctctaaaggttattatattggatttaaagcaactgttgtattagattatgattctatgaatcctgtttgtattttagtccactctggagctccaaacgatgcaaaacttttcgaagaaattttagaaaaccttcaaaaaagacgaataatcagaaaaggagacacattaatctttgataaaggatattacacctataaaaactaccaaatcggaatcagcaaatacaaaatcattcctttcatttttccaaaagaaaaattcagcagaacccgattggatgacattttaacttatccactagccgtatttaacaaaacaaagagaataatgaaagaaaaaagattatacaacagtttaaaaatggaattaatgaaaaaaatagattcatgggaaaaatttaaaccaataaggggcaaaatagaagattttttcaaattattaaaacaaggcttgaatatgagagaaatccacaaatatactccaaaatcagtagaaaaaaccgtttatctaaatgtatttttgggagcactgattatatcacaaggattttact

SEQ ID NO: 1372 - DNA, 135 bp, Methanobrevibacter ruminantium
atgactactgttgtatatacagtttcaaatgctgttctactcatgctgttctactcatggtataatttatatgaaaaaggagtaatttctgaggaaagatttggaagaaaaaggaattattacaactctttttaa

SEQ ID NO: 1373 - DNA, 849 bp, Methanobrevibacter ruminantium
atgagaaaggaacgtattaaatcctatttgggaattatatttgatcttttggtaattttagacttgattctaatatttatctctttgcctatacaaggccttcacttgattgactatgcaggttttgtaagggcttttgacttaacaatctgttttctcctattaatcgaattcttttatggattatataaatcagatgctaaagccaaatatttcaaagaacatttcctagatttaatcgcttcaataccattcgatttaatcgtatttgccttattcggttcaagttccattatacttaatttggctcgtttcttacgtttggtcagagtcgtcagagtgtttagggctgtaaatatagttaaaaaatatggtttggaaaaggttattaggcgtactcatgcagataagatatttattgtcatagctgttatagttgtcatattcactattctcttaactctttccggtcatgaaaacatatccgacagtttttattttgttgtgatcaccttaaccactgtaggctatggcaatgaaggttttaatgagcctttagcgaaatttgtgacattatttttaattattgtcggtgtattggtcttcagtactatcactggtgtaacctcatccttctttatagataagatgctggaagagggcatcagtgtggatgagaacttacatttcataaatcaaaagttaaacttccatgaaagggaaatggaaaaaacaagaaaagaattggctgaaattaaaaaggaattggaaaagtctaatgagaattcagaagaattaaagcaagaaatatctgaattaaaagagttaattaaagaaaataataagtaa

SEQ ID NO: 1374 - DNA, 1024 bp, Methanobrevibacter ruminantium
atggctgataaaaaattcttagatgcaatgactaaaaagttcaaagaagctccagaagaaaaaactactaccttctataatatgggcggttggactcaatctgaaagaaaaactgaatttgtaaacgaaggtaaagcaatcgctgaagcaagaggaattccaatgtacaacccagacattggtaacccacttggtcaaagagctttaatgtcctaccaattatccggtactgacactttcgtagaaggggacgacttacactttattaacaacgcagcaatgcaacaagcttgggacgatatcagaaaaactgtaatcgtaggtttaaacactgctcacaacgtactcgaaaaaaggttaggtatggaagtaactcctgaaaccattaccaactacttagaagttgtaaaccacgctatgcctggtgcagctgcagtacaagaacacatggtagaaaccaacccattactcgtagacgactcctacgtaaaagtatttaccggtgacgacgacttagcagcagaaatcgaccctgcatttgtattagacattaacaaagagttcccagaagaacaagctgaagctttaaaagctgaagtaggcggagctatttggcaaattgtaagagttccatctgttgtaggtagagtctgtgacggtggtacaacctccagatggtctgctatgcaaattggtatgtccatgatttccgcatacggacaatgtgcaggtgaaggtgctactggtgacttcgcatacgcatccaaacacgcagaagttattggtatgggtacttacttaccaatcagaagagcaagagcaggtaacgaactcggtggtgtcccattcggattcatggcagatatctgtcaagcaaccagagtaaccgacgaccctgtagaatctgcattagaagtagtagctttaggtgctgctttatacgaccaaatctggttaggttcttacatgtctggtggtgtaggatttactcaatatgctaccgcagcatacaccgataacgtat

SEQ ID NO: 1375 - DNA, 489 bp, Methanobrevibacter ruminantium
atgataatagtcactacaatctgtgttatcttaattttgatagttcttttttatggattgttccctggattgacaaacagcaatgataacagtgacaataatctaattattcaaaatcagacttctcattttaccatagatattgaaaacggcacttatttaagcggagaaggcaaatctaaaatggtggattccaattattccacattagaatcctatgagaattttacgatttcaggctatgaggcctatgagatagaacttgacaatggctcttggtatatagtcagtctgtataaggtggattataatactccatctagcgattgggtatataatagtgatgtagatgaggatggaaacgcttatatcttcttcaatagcaaaggagagtattatggctactttattaacattccaagctctagcgatccttccacttttgagaatttaagctttttaactagcattttccattataatcattaa

SEQ ID NO: 1376 - DNA, 837 bp, Methanobrevibacter ruminantium
atgttaaaaactaaattatgcggaattagtttaaaaaatccattaatgcttgctgcaggtgttttgggaagccatgcatcttctcttaattggattttaaattctggtgcaggtgcagttgtatcaaagtccttctcaaaggaaccaaacgaaggatacaaaaatccaaccactgtagctgttgagggaggtatcataaacgctatcggactttcaagccctggcgttgatgcattcatagaggaattggaatctgtaaatagaatcaaaggcagatcaatcgcttcaatctatggagcaactcctgatgaattttcatatgttgcaggcaagattgaaagtttggttgacatgattgagatgaacatatcctgtcctcatgcaatggaaggatatggggcttccatcggtcaaaatcctgatttaacaagagaatttgtctctgcagtaaaggatactgtcagcgttcctgttcttgcaaaattaaccccaaatgtaacaaatatttctgaaatagctattgctgctgaagaagggggagctgatggtttgaccttaatcaattcattaggccctggaatgaaaatagatattataactggaaatcctattttggccaataagtttggtggaatgagcggccctgcaattaagcctattgctgttagatgtgtttatgacgcttatgaggcaacagacattcctattgtaggtgttggaggcattcgcaactacactgatgttgtagagttcttgtatgcaggtgccagtgcagttcaaataggaacatccattatgtatgaaggtcctgaaatatttggcagaatccgcaaatga

SEQ ID NO: 1377 - DNA, 1024 bp, Methanobrevibacter ruminantium
atggaaattgtattatgtgtaacaggcagtgtagctgcagtggaaactgttaagttagctcgtgaatttaagcgtcaaggccattcagtcaaggcatttatgacccaagaggctacaaagatcattcatccaaatgctttagagtttgcaacaggtcaagaggttgttctagagctcactggaaagattgagcatgttaaatattctcaagcagacctaattttagttgctccagccactgcaaatacaataagtaaattcgcttatagaatttcagataatcctgtaaacacccttctgataactgcctatggccatgacactcctatcgtatttgttccatctatgcatgattcaatgtatgatgcagtgagtgagaatgtggcaaagctaaaggaagagggaattgttttcttaaatcctcgcttggatgagggcaaggcaaaattcccagctattggggatattgttcttgaatccattcgcactgttaatcttgatagggttaaaaagaatttaactgacgattctttagatgaaagcgaaattgaagatttaaatatggaaatgctttctaaaattgcaggattaaatgttttgataagtttaggtggaacatttgaagagatagatcctattaggggaatatccaataggtcctctggtaagatgggtcttgaattggctaaagaggcttataggcttggagctaatttaaaaatccttgctgcacatcatgaagtggagattcctaaggtctttgatgtgattgatgcaaaatccagtagcgttatgagcgaaaagacaattgaattggttccagattttgatgtattcattgccactgctgcagtttcagactttgctcctattgttaaggaggattataagatttcttcatcattaaatctttccttagagttcgaacctgttgccaagattattcatcagataaagaagattaatccagacatatttttagttggatttaaggcagagtataatattccagaggaaagaatga

SEQ ID NO: 1378 - DNA, 1024 bp, Methanobrevibacter ruminantium
atgttaagtatggctagtgtatgtgctagtgatgttaatgatacatacataaatcaaaatgatttaaaaatcgataatcaagataattgtattaattatgaaaaagtagtttatacagaggaaaacttagaaaataatttaatttcaactgaagattctttggaggatagcaattctattgaaccgtctgattcatttaaacaaaaaaattcccttaatgaaggaaattccgatgaacgtttaaatccagaaatagatgttgctttgaattcaatccatgttaacgaaactgctgaagtcaatgttacagttagaaatgctagcggatatgttttagtctcagtggatgatcaatcttttaataaagaccttactgattatcaggctagattcaatattaccggacttggctttggaaatcacaatattgcagtctattatggaggggacgataactatcttccaggatttaaattggaaactatctctgttgaaaagtaccaaacccaaataagcgagattgaaatcggtgaagtttattatggggaagatgccattattgaagtcagcgttcccaatggtgttgaaggggatatcacaatcaaaatcaatgacactctccaaacagtgattactgaagccattcatgatggaatggcattattttcagtttctggtttggctgtaggcagctattctcttgatgccacatataatggaaatgattattatgaaaacgatactgcatctgccgaatttgaagttaaaaaagcagatccgaatttaagcgtggtatcatttgaatgcactgtttatgacaatgctacaatactggcttcaatcaatgaagagattcatgacgagtttgtaaacattactgttggagatgagaaatatgaggactgtcctattgaagattatggtatgatagcatttacagggggagttctctcaaatttttcctcttaccgcattctcatagaatatgggggcaatgagaatttcgaaagcgctatgatcgaag

SEQ ID NO: 1379 - DNA, 363 bp, Methanobrevibacter ruminantium
atggtagttgcaacaataatctttgcatccagcttattcgacgccctttatggatttaaaaacttaattcagccgggaataagtttggtttatactgctattgggactcagcttgctccaaacatggttacattagttgtatttgattggagaggattcgatactttaggagaatcattgatcttagttactgcagtgcttgtcgtattgcttatctttggaaaaggtaagattttggataagaatgtaaatgcagataatgggactgcagattctaatttaacccatgaagcagatttagaaattggcgattctgatttagaacttgatggtgctgatttaaatgaaggagatgatgaataa

SEQ ID NO: 1380 - DNA, 480 bp, Methanobrevibacter ruminantium
atgatattggcaatattgcttgccgttggaatgacacttactgcagtaagtgcagaggacagttggagttttaacttctccagcgaagaaaactccgacggaggatcaataaactttgaaaatggaaaattgacaatacaaggtattgaatttaccattcctgacggatatgaaatggatgaatcatcaaagaaagtagctgaagacgctgaagattttgatgcaaaatattcagcatgcaaattcactaaaggcgatgatgaaattgttgtaaatgtcttctttacagatggggatttcgaaaaccttagcgcaaataatgccgaccaagtcgaaaaaaccttaaacgacattaaaggtttatacgaagaaaataaatatggcgataatactccaacattcacttatattgaagatggtaaagtcgttaaaataaatgcccctaatgatgaaatcattgaatcagtaatgggaaaataa

SEQ ID NO: 1381 - DNA, 1024 bp, Methanobrevibacter ruminantium
atgaataagcgaatatttctatatatagcactgatttttattatttccctgctttctttttctgcagtcagtgctaatgaagacatttcaagtgacaatctcatcttggatgagaatgtttatgatgagaaaatcattttagatgatgttcaagataagaatatcatatctgataatgattatgacgatgtcattccagttgaaaatgctaatgataatgcaattttagctggaaatgatgaagaacttattttagatgagaataacagtgaaataagtgaggataataaaaatgataagaccaaactctccgatccaaacacatattcttttacccggctgaatcaagccataaatagtggagctagtgtaataaatttaactgacaattatcagtataccgagggggatgaatcattcattcatggtatcatgatcagtcgcagcataacaataaacggaaatggcatgacaataagtggttcaggcgttgcccgtatttttgaagtatttacttctaatgttatcatcaataacattacttttagagatgcatatgcggaaggagatagtaatcgtcaaaattatggtggtgctatctttatgtatggttcagacagcatagtccaacattgtaaattcattaacaacaatgcaaataatgctggtggcggcgctatcgtattggtgggttcaaacagcagagtagaatattccgacttcaccggcaacaatgggcaaaatggtggagctgtctatttgtatggtaataacaccaaggcgatatattgtaacttcaccagcaacaatgcaagcgagaaggggggtgctgtttatacctacggatcagatatcacagtcgaattctgtaacttcaccaacaactctgcatatctagagggtggcgctatcgattgggaaggtgaaagggggactgtcaaacattccagcttcgccaacaacactgcaaacaataatggtggtgctatctcatggtatactgccaacgggactgtagaacatt

SEQ ID NO: 1382 - DNA, 1024 bp, Methanobrevibacter ruminantium
atgaaatataataaaaagatattctttttatttttattattgtgtctcataattcctcaagctatttatgcaggggatgttgatgatttatcggatgctggtaattacactagagataattcacctttaacaataagttccacttatcaaagttctacttatggatccgatgggggatatgatgataaaaatgagaatatttatattttagataaagttagtgatggggataaatctaaaacatgctgttctaaggacctttctttagataatgcttgttctatggataaatcttcttgttctaagagcaattcagcttgttctaagggcatatcttcagataaagattcatctaacttgtctaatacatatttagtttctgaaaataattataatgattttaatgttgatatagatttaaatgataaactttcagatttggatttaaacaatgatttaagtcttaataaagatttaactcttaatttaaattcaaataacgatatggattatttaaatcttgaggaagttattcagacagatggaactttaacttatgagggcgatttggatcaaacttatttaaacgatgagtctttaaatcaagatgttcaaaatgatgattctttaaataaaaacgatttaaaatccccattaagtgatgaaaacacatttaatatttttataattagtgataatacaggaaataatctttttgatgcagtggcatgtgaaatcttagacaattccaatttttctaatgtcaaattcaatataagaagcggaaaccaaataaatgcaatgagcgaggatgaaatctatgaactgatggctccttgcgatgcattcatcggccagtgggtaagctccaatgtggatgcagtattaaccagtcttttaaacaatcatcctgaattgtcaaataagaaactgttccttatcttggaaccacctactggaaacatcaattcaagctccagttcattgaatttggttagaaactctacaattgactataagaaga

SEQ ID NO: 1383 - DNA, 1024 bp, Methanobrevibacter ruminantium
atgtcttttggagctgtctcagcagctgacctaaatacagtccagtccggtgaggtttcaggtggagttgacatagccagctcaaatcctggagtcgaaaatggagaattgacttacgaaattccagatagtgttgaaaacattcagtatgcagggctctttgttgacagctatactgcaggatcctctaatttggtatatggatccgaagcaaatatcactttgacaaaaaacggcgaaagcgaacagatagcaagtgaaagacttgttgcaagtgtgggaagtgcagacggtgaggtatatgtcattaacgaccacacaacaaaatgctttgcagactatatgatgacctataaccttacagacagacttcaggatgcaaagggaaatatcacaatcactgtaaatgccactcctatcgaaggatacacattctataataaaatcaagctgataggccttgtatttacatatgatgatggagatggagaccaattccattattgggtaaatgcaggttcatcttgggtaaagacagatagcggagagacaagcaaggctacatttaagcttggaaacgtgaattacgacccaactgtagccacccttgataactttgccctttcaagccaggatggtgtctataccttcaatggcaaggagatggatgagtccatagtcactgaaacaggggtatactattatatccatcacaagtttgacatattggataagattaagaacatgacaaacacccttgtatacactccaggggaaggctcatactcatttagaaatgttctttcagtggtaaagctggtaaagacagttccagtctatgctaaagtcaacataagctctgaatatgatgacattgtcttttcaggaacagaaaatctgcttaaggtgggcataaccaataatggtacaggctctgcatcctatctcttggatttatatgccgatgggaaaaaggtaaacagttctcaaatctcattagctgcaggaagggaagctgtaatat

SEQ ID NO: 1384 - DNA, 1024 bp, Methanobrevibacter ruminantium
atgcctgtatggaacaccacattcaatggcgtaactgtcactcctgttgcacattacagagaccaatccaatatgggaacctacggcaaatatggctacggacttatcgtttacgatgtatctgaccttattgtagctggtgaaaacacattcaccttagaaaaagaaaatggaaccactgcagtatatccaagtacccttgtagcattctataatatgcctgaatccagcacttatgtaactacatacctatacaatggcgcagacttattatccaatgcaaacaacttcttaggaagacttgttgcatctaacagcacattggatatcgattcatttgacaatatagtcggcgctgaccttttagtatttgcagctagcgctcaagctggagaaggtagccttgtcataaatggcgatcttgtagctgacatctggaatggcagcagcaacagcgtagatgcatatgctattgacttaggcaaaaaccctaaggcatctaatgaggtatcatttgttgcaaccggatctaccattctagcattgcaacagttcattgttgttgaatacaatgttccttcagctgaggcaagcctcgttagcgaatattctaatgttgcattcgctggaaccaacaatgtattgcaattcaacttaacaaacaacggcgctcttaacacttcttacattgtcgacttctatattgacggcaagaaggtaaacagcactcaaattgcactcaactctggcgaaagctttggccaatactttatcgatgatacaatcaggccagttgacgcaagcactgtaaacggcgcagccaatgctaaggtaaactacacagtcttagtcagcgataaggataccggacttatattggatgaagtgaccctcactccttctgtattatataacggtaacttaggcaaggacttagcacatcctccagaagaaatcgtcctatttgacacaatcactgtaaacggtgatgtgattatagatacattagatgattctacctatc

SEQ ID NO: 1385 - DNA, 1024 bp, Methanobrevibacter ruminantium
atgaattctaataagacttatgcagtattaggattattgctcttattaatcttatccataggcgctattagtgcagaggattctatagatgatatgagtttaacagacattaattctgcagataattctaatattaatcaaataaatgcaattgataattcaattgatacaagtacagattcttcaattgatacagacaattcaattgaaacaaatctggatagttcaattgaagataaaaactctacagatgcaaagaacacactttcctcaaacagtcttgcatctacatataagataactgaaaaagactacttaacttactttgataaagatggaaacatattatcaggcaaattaaaaagtggagatactatagatctctccggaacctttagtaaaaaggcttttgtcataaacattccacttaccataacaagtagcgatggcactgcaaagctcttgaactccaacataaaccttgtaagtggcgctcaaggttctatggtgtccaatttaaatatgaatacaagcgttgaaaagactcctgcattaagcgctgtcaatgttacaaaggtctcctttgtaaataacacagtactttcaactgcaacaggctcttatgccttattgctcaatactgtaaacaattcagatgttctatttaacacattccaaaccacatgctttgtggagggctggggacatccttctgctttggtattaagcggttcaaactataacaatatctcatcaaacaatgttattgtaaacgattcaaatggaatctacttgaccggataccttggcggaggaagcatgggagattccacccaaggatccaatacctacaattatatatacaacaacacagttcacagcgtaagaggagttgaatgggcaaaggataaggatggaaacaagcctctcccatcttcattctgttatggtatccaagttatgggtgcatataacgaaatcattgaaaacactgtatataatatgtacagaggcataagcgcta

SEQ ID NO: 1386 - DNA, 1024 bp, Methanobrevibacter ruminantium
atgataaataaaagaataattagtcttagtctgctgattatattggtctttctcattattggattaagtgcagtcagtgctgaagattcttcaaaagctgctgatttggacttgaattctagttcagtttctaatattgatttaagttctaattctgttgctattgaatctaattccaattctattgctagtgaatcaagttctaatattgtcttggataataaatcttcagacactacagatattcaaacagattctgattctagttcagatgataatctaaatcacgattctaatagtaaaatcaaatcagacaattctaaaaaggttcatactataacagaatctaattattcactctattttgattctaacggctatctaaacaattcattagtgtcctctaatgatactattaatttgtctggtaatttttcttcaaagtattttcgcttttcaatacctttgaccattacaagcttagaaaacgatgcattcctaagaaactctccaatcataatcactggagtttccaacgaaaactatgtatatgatgcaattgtctctaacttgaccattgaatcagaccttgctaacatatctgccgtttgggtgattggttcaagcaatataaaggtcttaaacaataatatattcacaacaggtcataacggatatcctatcgctttggatagctttgtatataactgcattcttgcaaacaatacaatcaagacaatagttcctgtcagcgaagcgatgagctcaaaggatatcgatgaggacaatcaaacaaacaattccgacaatagcagttggcagcattcaggaattagcctaagggatgcccattacaatactgtcgttgacaatgacataactgttgaaaactcctatggagtctatctctgttatggggcttccatatcaaactataatgtcattgcaaacaatacaataagggcaacctctgaaactccttcattttggtgttatggtgtttatatcactggaaactacaatc

SEQ ID NO: 1387 - DNA, 1024 bp, Methanobrevibacter ruminantium
atggattttaaaaaagcaatccctctatttgctttattgctattgattttatttattatcggctcttcaagcgcagcttcaagtgatcttagttcaagtcctgccgataatgaaaacttggaaattgatagttttgactcaaatgaggatttaacagttaatacgaatacaaactatattgaaagcggaaataatttggaaattgattataaatctaattctaaagaatctgttaatgcaacaaatgatataaaagaagaaactgttgattacaatgaagatatttcagttgaaaagaataatctaaagtcttctaaattgagttctgtttataaaataacagaatctaactactctaactactttaataaaagtggaaacatcctatctaatgtaaaccctggagatacattagatttttcaggttcattcaacaataaggactttaaaatagatattccattgactgttacaagcagtgacggtgctcaattcattgattgcagcttcaagttcaataagggctctgacggctctaacatatccaatttaaacattaactcttctcgcttacaaagtccgcttatctatttggattctgtcagcaatatgaatgtattcaacaacaatctattttcctgcgcttcaaaatcctatgctctttgctttagcaatgtaagctattcctctgcatatcacaacacccttcagactacagcatttgttgtaggatggggacatccttctgcctttgtcttggctggagcaaataacttaaatatctcctcaaacaatgtgatagtcaacgattccaacggaatctatttcactacatatgttggagacacaattagcgcgaacttaatcaatgaaaataattatatctttaacaataccgttcacagtgtccgaggagttgaatgggcagttgatgaaaatggaaccactcctctcccatcctctttctgctatgcgatacaagtgatgggaagcggtaataaattattgaacaatacggtctaca

SEQ ID NO: 1388 - DNA, 1024 bp, Methanobrevibacter ruminantium
atgaagcttaaaaagttttcagtcattttagcggtattgcttgtagcaatacttgctattggggctgtaagtgcagaatcagtctctgatactgatgtagctgctgtagctgctgtagatgatacagcaggcacagtatctgtagacgattctatagatgatgtttccgtagacactacggataatgatgttaaaaacagtctgagtgctgttgcccttgaagatggggagagtgtgagctatgaaatcaacgacacttcttattccacatacttcaaagacgatggtactgcaactgatgaattaagtgaaatgggtggctataccttaaatataggaacccttactaataaagacattcagataatatctggttctgatattaatattactgcaaaggatggtgaaggattcattaacaatggtaccatcattcttggtggtgatgaattccctggtagcataattgtatctggattgacttttaccaataccaataaagacgctattcaagttttagattatactactgatgtcagtatctatgataacaatatgaatattataggaattagctctttatcatctgatcctaatttcagtgtttatggtgtaagtgccaatgggtttatttcaggattatatattgaaaataacaccatgtctgttgaaggagatgcgctttcatatggtattgaagtaggagcatattctgatggggcttacgctctttcaaaccctcaagatattttaatatctggcaatactattgatgtatctacttccggagcaatggctgagcctatgtatttatctgatgtttgggatgtaacagttgtaaataactttgttacagcagaatcagttaatgctccagcttatggtattcaagtagccgattctgcaatgtgggcaagttatatggatccaaattatgatggtgatttatcttctcctaataatgtactcatcgatggcaatacatttattttaaacagtgactttatgatttatggtatcacta

SEQ ID NO: 1389 - DNA, 1024 bp, Methanobrevibacter ruminantium
atgattttaatatccttaattttagttatcttaagcatttcttgtgtaagtgctaatgatttaactaatgatgctattcaaggcgatttaagtgatattgattattcttttactattgatgacgatttaagcaattctgataattcattagatgtttctagtgatttaaaagaaaacagttgtcttgatgaaatcgatttggataaggaatctaaccaaaatactacaaaaatattaagttcaaaccaattagactctaatttattggattcaaaccaattagaatctgatcaattgagttcaaaccaattagattctagtttactcaattcaaaccaattaaacttatcaaatacatacacagtctcccaatcaacttattcaaaatactttgataagaatggctatgtgaagacatctgtagtggctccatatgatactatagacctgtcaggcaatataatatctaaaaacttcatatttactattccatgccatataacaagctccaataatgcaaagctcacaaactgtatgattaagtttgaaaacatgactgctgacggccgttcaagtgtctcaaacctatacataagaaacagcgtcgaatggtgtcctggagtctttttagaaggatccacaaatgtggatgtctatggcaatgacatttattgtacaggggctaacggaaaccctgtccgtgtgatatactccaattattcaaacatatttggaaacaagcttgagacatactttacaggctatatgaacctttcatggaaacgtgcaggtatccttcttggagactctcactacaataacatcttttcaaacgatgtaaccataaaggactcaaatcctatctaccttacaacatacggatttgaaaagtccaatcataatacaatatacaataatactgtaagatcatctgcaatcagtgaagatagcggtttatcaaacccttcggcatgggcttatggaatacatctgatgggagattataacattgctctcaataata

SEQ ID NO: 1390 - DNA, 555 bp, Methanobrevibacter ruminantium
atggacaactccaatattataatctcagtaattatagtattatgtattgcagcaggagtaactgcatatggtataagtgagggtgataatgcagtcttcagtgatttaactggattttcaccatctagtactgattctggagatactggaataggaaatactactggaaacaattctcaaggcggcggaataaccgcaggtcaaactaatgtggctaccaacactggcggcagctcaagcggtggctcaagtggttcaggcagttcaggaagtggttccggaagcggttctggatcatctggctctggcggaagttcctctggaaatggcggaggaaatactaacccaagcccaagtcctagcaaaataagcgcagcccaagctaaaaacatagcagctggcgcaattgccgaagaaggcgcttatatcagcagcgtatcagatactggatcagcctatgtctgttatatttctaatgcagaaggtactaatgtaggttacattactgtatcatacggtggagcaattattgaaggtgccggaggcgcaccttaa

SEQ ID NO: 1391 - DNA, 603 bp, Methanobrevibacter ruminantium
atggataattcaagcattcttatatccgtaatcatcgttttatgtattgcagcaggagtaactgcctatggacttacaaatgacagcaatactgtatttaatgacctctctggatttactcctgacgaatctggagataccggtataggaaacaataccacaggaggaaacggaaattcaggtagtggaataactgcaggaacaacagactctggaagtggaactggttcaagcggcactggtaccggctcaagcagcagttcaagctcaagctcaagttcaagttcaagttcatcaagtagttctaatactcagcaaaaggcttggaaacctaaagtcagtccagaaaaagcaaaagcactcgcaacaagtgcagcaagaaactcaggatggcctggagcatattgttacagtgcaacatataattctggcggatattatgtctgtcttttaaaagatgatgctggaaacactggttatgcgcatatcggttctggaacaggcagattcttggaaggatcctggagcaaacaagtaactaaagagcctaatgaagtggaagacgattataaagaaaatgaaacttccaatattactgaataa

SEQ ID NO: 1392 - DNA, 1024 bp, Methanobrevibacter ruminantium
atgagaaaggaaattttaattgcagctattgcaatcatattaatattatgtggaggtgtatttgcagctagcaatatgcagatagcggatattgctacttttagtttgaatgcaattgatctcgaggataggggaagcttaatcgttgactctgaagatatcactgcttcaaagggctattataattcttcggcttctgatgagaatgtggttttggttaaaaattatagcttaagattaagcaattcaattgtaaataagactggagacactggaagctctggagatgatgcagacttttatgggattaattctgcagttcttgtaaattcaaatggaagtgtagaattatctgatgttgaaatagagactaattctaaaggatccaatggagtatttgtaacaaatgctgtttctgattctaattcaaattcttcatcctcttctggcagccctattgttgattccactgaacgtcatgatggaaagagtgatgctgaagagcctggtggtgttcctcctgaaaagcctgttgaggatggaccttctgtatatggcggttcttcaggaggtaaaggtgcccttagcgatggaaatcaatctatgcctgctccaggcgctagctcctctgatgtggaaggaagttcaagtgcagacatctcaaatgtccgaatcaccacacatggagacaagtcccgcggattggatgcaacctttggaggaaagattattgcttcagatgttgaaatcaatacagatggccaaagctgtgcggctcttgcaacagacagaggcgaaggtgaagtccatgtgaaaaactgcatattgaatactggagtggatgagaaaagcggaagaggctctccaatcatctattcaacaggaaacattacagctgacaattccgaaggctgtgcccatgtctcccagattgcctgcatagagggaaaaaacagcattgcgctatcaaactgtgagttctctgcaggtgcaggaggaaatagggaagataatggagaatatg

SEQ ID NO: 1393 - DNA, 1024 bp, Methanobrevibacter ruminantium
atgttgatatcaattgtacttatatctctcattgctttaggtgcagtaagtgcagctgacgacgtcgctgcagatgatgctgttgccccagcaactgtagatgaagttcaaacaattgataatacaataacaaatgatgatatatcatatgagtctactgacataattgttaatgatactggcgactcagctgattctaaggcaaaaaccacttcccttagtgcaaatgcagtaaacgaaggggaaactttgtcttttacacaattagctgctgatgtctcttccagtccttcaatgttgtcaggtgcttattataaatatgatccatcaaccgacactgcttttgaaaatggtatcactcttaccaatggcttaacaatcattggtggcggtgcgaccattgacggggataatcaagcaagaatattcaatatccctgaaggagttagcgttaccattatgggtgtaactctcataaacggtgctgccgatgaaggtgcagctatttataactccggcaagttaactttaatgaatgctaaagttaatgacaacacagcagtcaagtctggtggtggtatttataataatggcggtgaagtattagtaacctccagtgaatttgatggtaacgatttaactgacagaacagttaatggctatggtggagcagctatttactccaatggaggttctgtaaccataacagatacaaatgttaccaacaaccttaagaacatagttcacagaggaggaactggtacttacacaggtgacttaagtagtgctgctgttacaagtaataacgctgatttaactgtaaccaactctcgttttattgctaacagtggttcctacggtggtgcaatttactctggtgagagcacttctgcaaatttattagtaagcggatctacctttgaagacaactttgcattcaatggtggagctattgatatagttggaacttcctataccatatctgattccacattcaaaaacaataatgttaaaggaactggta

SEQ ID NO: 1394 - DNA, 414 bp, Methanobrevibacter ruminantium
atgaaagaaattgctatttatctcatccttatcataattgttcttattgccgcacaacacttaaatgtagttgtctcaggtagtatggaacctgttatgtatagaggagatattgtagtacttcaaaaagctaatttatttggaatacatgaattcgaccctcacgatgttcaagtaggggatatagttgtttataatgccgcttggtatgacagcccagttatccatagggttataaacactgcagagatcaatggaactacctgctttgagataaagggagataataacaataaatcggacccttattgggtgactccagagcagattacagatagagtcattacaattaatggccaaccattggtaattcctaaaataggatatatcactttatgggttaaaggtctttaa

SEQ ID NO: 1395 - DNA, 399 bp, Methanobrevibacter ruminantium
ttgtttgaagcaggtatgattgctcttcctactggtttgcctggacttgccttgttggggcttggtactgtgttaacagcttatggcagtggaatgttcgatgatttaggaacagatcatccaggttatgcaaagccggaaaatcaattaaacttcggattatccatggggcttaactttataggattaggtgctagtgaaggacttgcaagaggggttctctataaagaagttcaagaaaaactagttacaggatttgtaccatcaattaaagcctatggaaaaacaataatggatgagtcattaggtaaaggaaatgctaagatttcaactgttatttgggcttatgtggaaaatagtgtaattcttgctatagaaaattcaatcaatggtggttaa

SEQ ID NO: 1396 - protein, 6 aa, Artificial Sequence
  Description of Artificial Sequence: Synthetic 6xHis tag
HHHHHH

What we claim is:

1. A vaccine composition comprising a polypeptide comprising the amino acid sequence of SEQ ID NO: 641; or an amino acid sequence which shares at least 90% identity with at least 10 contiguous amino acids of SEQ ID NO: 641, and an adjuvant.

2. The vaccine composition of claim 1, wherein the polypeptide of amino acid is a conjugate or fusion molecule.

3. The vaccine composition of claim 1 for use in vaccinating an animal against a methanogen.

4. The vaccine composition of claim 3 wherein the methanogen is *Methanobrevibacter ruminantium*.

5. The vaccine composition of claim 3 wherein the animal is a ruminant.

6. The vaccine composition of claim 5, wherein the ruminant is selected from the group consisting of cattle, sheep, goats, buffalo, moose, antelope, caribou, and deer.

7. The vaccine composition of claim 1, for use in reducing methane emissions from a ruminant.

8. A kit for reducing methanogen growth or methane production in a ruminant comprising a vaccine composition of claim 1.

9. A method of vaccinating an animal against a methanogen, comprising the step of administering to said animal, a vaccine composition according to claim 1.

10. The method of claim 9, wherein the methanogen is *Methanobrevibacter ruminantium*.

11. The method of claim 9, wherein the animal is a ruminant.

12. The method of claim 9, wherein the ruminant is selected from the group consisting of cattle, sheep, goats, buffalo, moose, antelope, caribou, and deer.

13. A method of reducing methane emissions from a ruminant, comprising vaccinating the ruminant against a methanogen according to claim 9.

* * * * *